(12) United States Patent
Al-Mahmood et al.

(10) Patent No.: US 7,553,492 B2
(45) Date of Patent: Jun. 30, 2009

(54) PHARMACEUTICAL COMPOSITIONS CONTAINING ANGIOGENIC ACTIVATORS

(75) Inventors: Salman Al-Mahmood, Paris (FR); Sylvie Colin, Paris (FR); Christophe Schneider, Reims (FR)

(73) Assignee: Gene Signal (FR)

( * ) Notice: Subject to any disclaimer, the term of this patent is extended or adjusted under 35 U.S.C. 154(b) by 532 days.

(21) Appl. No.: 10/934,998

(22) Filed: Sep. 3, 2004

(65) Prior Publication Data

US 2005/0153917 A1 Jul. 14, 2005

Related U.S. Application Data

(63) Continuation of application No. PCT/FR03/00695, filed on Mar. 4, 2003.

(30) Foreign Application Priority Data

Mar. 4, 2002 (FR) .................... 02 02717
Apr. 11, 2002 (FR) .................... 02 04546

(51) Int. Cl.
*A61K 38/00* (2006.01)
*C07K 14/00* (2006.01)

(52) U.S. Cl. .................... 424/198.1; 530/351

(58) Field of Classification Search .............. None
See application file for complete search history.

(56) References Cited

U.S. PATENT DOCUMENTS 5,504,933 A 4/1996 Saito

FOREIGN PATENT DOCUMENTS

EP 0 753 225 B1 12/1998
WO WO/94/01548 * 1/1994
WO WO 99/33869 A2 7/1999
WO WO 99/57132 A1 11/1999
WO WO 01/21831 A1 3/2001
WO WO 01/66742 A2 9/2001
WO WO 01/79556 A2 10/2001
WO WO/03/029271 * 4/2003

OTHER PUBLICATIONS

Lee et al., Hirudin inhibits human tumor implantation and metastasis in nude mice. Blood, vol. 96, No. 11 Part 1, pp. 818a, 2000- meeting abstract: 42nd Annual Meeting of the American Society of Hematology. San Francisco, California, USA. Dec. 1-5, 2000.*
Kawabata et al., Hypothetical protein FLJ22029, Nucleotide sequence submitted (Aug. 2000) to EMBL/GenBank/DDBJ databases and integrated into UniProtKB/TrEMBL on Mar. 1, 2001.*
W.H. Brondyk et al., *Cloning vector pCI-neo*, Mar. 18, 1996, XP-002219165.
R. Strausberg, *Homo sapiens clone MGC:14841 Image:4295121*, Jun. 8, 2001, XP-002223765.

* cited by examiner

*Primary Examiner*—Lorraine Spector
*Assistant Examiner*—Elly-Gerald Stoica
(74) *Attorney, Agent, or Firm*—DLA Piper LLP (US)

(57) ABSTRACT

The invention relates to therapeutic compositions used in the field of angiogenesis, comprising nucleotide sequences of genes, the involvement of said genes in the angiogenesis mechanism having been demonstrated by the Applicant, and including the complementary sequences thereof, the antisense sequences of same, polypeptide sequences coded by the coding parts of the aforementioned genes and antibodies that are directed against said polypeptide sequences. The invention also relates to genetically-modified cells that underexpress or overexpress the above-mentioned genes and to therapeutic compositions containing said cells, which are used to treat angiogenic disorders. Moreover, the invention relates to methods of diagnosing and/or prognosticating antigenic disorders and to novel methods of screening active compounds in the treatment of said disorders.

3 Claims, 11 Drawing Sheets

1A) GS-V1

1B) GS-V2

1C) GS-V4

1D) GS-V5

1E) GS-V15

1F) Control

2A) GS-V3

2B) GS-13

2C) control

3A) GS-V6

3B) GS-V8

3C) GS-V10

3D) control

4A) GS-V8

4B) GS-V10

4C) GS-V12

4D) GS-V13

4E) GS-V14

4F) control

5A) GS-V16

5B) GS-V17

5C) GS-V18

5D) GS-V19

5E) GS-V21

5F) Control

6A) GS-V22

6B) GS-V24

6C) GS-V25

6D) GS-V26

6E) GS-V27

6F) Control

7A) GS-V28

7B) GS-V29

7C) GS-V30

7D) GS-V31

7E) GS-V32

7F) Control

8A) GS-V33

8B) GS-V34

8C) GS-V35

8D) GS-V37

8D) GS-V38

8F) Control

9A) GS-V40

9B) GS-V42

9C) GS-V43

9D) GS-V44

9E) GS-V45

9F) Control

10A) GS-V20

10B) GS-V23

10C) GS-V36

10D) GS-V39

10E) GS-V41

10F) Control

11A) GS-V46

11B) Control

PHARMACEUTICAL COMPOSITIONS CONTAINING ANGIOGENIC ACTIVATORS

RELATED APPLICATIONS

This is a continuation of International Application No. PCT/FR03/00695, with an international filing date of Mar. 4, 2003 (WO 03/074073, published Sep. 12, 2003), which is based on French Patent Application Nos. 02/02717, filed Mar. 4, 2002, and 02/04546, filed Apr. 11, 2002.

FIELD OF THE INVENTION

The present invention pertains to the field of pharmaceutical compositions that are useful for the treatment of pathologies resulting from a deregulation of the angiogenesis mechanism.

The invention pertains to compositions comprising on the one hand sequences of new genes whose function had not been identified to date and whose implication in the mechanism of angiogenesis was demonstrated for the first time by the applicant and on the other hand gene sequences at least one of the functions of which was previously identified but whose implication as constitutive genes of the endothelial cells in the mechanisms of angiogenesis was demonstrated for the first time in the studies performed by the applicant in the framework of the present invention. These genes are identified by their nucleotide sequences in the attached sequence listing. The present invention also pertains to the polypeptide sequences of the factors coded by said genes which find their application in the clinical study of the angiogenesis process, the prognosis, diagnosis and treatment of pathologies linked to this process as well as in the implementation of pharmacological, pharmacogenomic and pharmacosignalitic trials.

BACKGROUND OF THE INVENTION

Angiogenesis is a fundamental process by means of which new blood vessels are formed. This process is essential in many normal physiological phenomena such as reproduction, development and cicatrization. In these normal biological phenomena, angiogenesis is under strict control, i.e., it is triggered during a short period of several days then completely inhibited. However, many pathologies are linked to an invasive and uncontrolled angiogenesis. Arthritis, for example, is a pathology caused by damage to cartilage caused by invasive neovessels. In diabetic retinopathy, invasion of the retina by neovessels leads to the patients' blindness; neovascularization of the ocular apparatus represents the major cause of blindness and this neovascularization dominates around twenty eye diseases. Lastly, the growth and metastasis of tumors are linked directly to neovascularization and are dependent on angiogenesis, and the tumor itself stimulates the growth of the neovessels. Moreover, these neovessels present escape pathways, allowing metastatic tumor cells to reach the blood circulation and cause metastases in remote sites such as the liver, lungs and bones.

In other pathologies such as cardiovascular diseases, peripheral arterial diseases, and vascular and cerebral lesions, angiogenesis can present an important therapeutic base. The promotion of angiogenesis in the damaged sites can lead to the formation of blood neovessels lateral and alternative to the damaged vessels, thereby providing blood flow and, by consequence, oxygen and other nutritive factors required for the survival of the tissues in question.

The formation of neovessels by endothelial cells involves the migration, growth and differentiation of endothelial cells. The regulation of these biological phenomena are directly linked to gene expression. In the area of angiogenesis, a constantly growing number of studies show that the regulation of angiogenesis is implemented via an equilibrium between the factors acting directly on the endothelial cell. These factors can be angiogenic stimulants, on the one hand, such as, among others, VEGF, FGFs, IL-8, HGF/SF and PDGF. They can also be angiogenic inhibitors such as, among others, IL-10, IL-12, gro-α and -β, platelet factor 4, angiostatin, the inhibitor derived from human chondrocyte, thrombospondin and the leukemia inhibitory factor. (Jensen, Surg. Neural., 1998, 49, 189-195; Tamatani et al., Carcinogenesis, 1999, 20, 957-962; Tanaka et al., Cancer Res., 1998, 58, 3362-3369; Ghe et al., Cancer Res., 1997, 57, 3733-3740; Kawahara et al., Hepatology, 1998, 28, 1512-1517; Chandhuni et al., Cancer Res., 1997, 57, 1814-1819; Jendraschak and Sage, Semin. Cancer Biol., 1996, 7, 139-146; Majewski et al., J. Invest. Dermatol., 1996, 106, 1114-1119).

One of the mechanisms by which cells respond to external stimulus is the recruitment of chains constituted by a set of proteins which provide for the relay of an external signal to the interior of the cells. By providing for the transduction of the extracellular signal, this chain changes the intracellular environment thereby controlling gene transcription (reviews: Avruch, 1998, Mol. Cell. Biochem., 182, 31-48; Karin, 1998, Ann. NY Acad. Sci., 851, 139-146). A large number of these protein chains, and by consequence the signal pathways which are highly conserved via evolution, are collectively designated the pathways of the "mitogenic agent activated protein kinases" (MAPK) (Gupta et al., 1996, EMBO J., 15, 2760-2770; Madhani and Fink, 1998, Trends Genet. 14, 151-155). The classic MAPK pathway is triggered by the binding of the growth factors to their receptor on the cell surface leading to the activation of the protein Ras, which is a GTPase. This pathway results in the activation of the protein kinases regulated by extracellular signals (ERKs), leading to gene transcription and cell proliferation. A parallel MAPK pathway is stimulated by stress factors such as osmotic shock, cytotoxic products, UV radiation or inflammatory cytokines. This pathway results in the activation of the stress-activated protein kinases known by the designation of kinases acting on the N-terminal of c-Jun (SAPK/JNKs) (Karin, 1998, Ann. NY Acad. Sci. 851, 139-146). A second stress-activated pathway leads to the activation of MAPK p38. The effect of stress activation extends to the proliferation, differentiation and even the gene transcription leading to the termination of this cellular cycle and/or apoptosis, depending on the cell type and the stimulus (Karin, 1998, Ann. NY Acad. Sci. 851, 139-146).

Many studies have reported a role for MAPK 1 and 2 as well as MAPK p38 in the transduction pathway of the signal induced by the angiogenic or anti-angiogenic factors during angiogenesis, but no role has been reported for MAPK4 in this process (Tanaka et al., 1999, Jpn. J. Cancer Res., 90: 647-654; Erdreich-Epstein et al., 2000, Cancer Res., 60: 712-721; Gupta et al., 1999, Exp. Cell Res., 247: 495-504; Bais et al., 1998, Nature, 391: 24-25; Rousseau et al., Oncogene, 1997, 15: 2169-2177; Shore et al., 1997, Placenta, 18: 657-665).

MAPK 4 is one of the members of the MAPK family. This kinase phosphorylates directly and thereby activates the kinases acting directly on the N-terminal c-Jun (JNK) in response to stress and/or inflammatory cytokines. MAPK 4 is expressed in different tissues, however there is seen an abundance of expression of this kinase in the skeletal muscles and the brain. Mice deficient in the gene of MAPK 4 develop abnormal hepatogenesis and die in the embryogenic state on the fourth day. However, cell lines deficient in MAP 4 have been obtained. These lines are characterized by the absence of gene transcription dependent of JNK and the transcription factor AP-1. Moreover, T lymphocytes deficient in MAPK 4 exhibit a decoupling of the production of IL-2 subsequent to the activation of the T cell receptors, suggesting a key role for MAPK4/JNK in the inflammatory process. The mutation of MAPK4 in certain carcinomas indicates that it can play a tumor suppressor role. Although the control of the expression and activity of MAPK is currently the object of intense analyses and studies, these studies involve an approach for developing an anti-inflammatory and anticancer therapy. However, the role of MAPK4 in angiogenesis has not been demonstrated.

Pedram et al. (Endocrinology, 2001, 142: 1578-86) showed that the natriuretic peptide suppresses or inhibits the angiogenesis induced by VEGF; they also showed that the activation of the kinases acting directly on the N-terminal of c-Jun is an important state in the induction of angiogenesis by VEGF. In opposition, Jimenez et al., Oncogene, 2001, 20: 3443-3448) reported that the activation of the kinases acting on the N-terminal of c-Jun is necessary for the inhibition of neovascularization by thrombospondin 1.

Neither of these studies reported a specific role of MAP4K4 in the regulation of angiogenesis.

The G proteins (proteins binding guanine) play a major role in the transmembrane signaling pathways by transmission of extracellular signals via the transmembrane receptors to their appropriate intracellular effectors (Gilman, 1987, Ann. Rev. Biochem., 56, 615-649; Simon et al., 1991, Science, 252, 802-808). After binding of the ligand, the receptor catalyzes the exchange of the GDP for a GTP in the alpha subunit of the heterotrimer G protein which induces its activation and the dissociation of the alpha-GTP subunit from the beta and gamma subunits (Gilman, 1987, Ann. Rev. Biochem., 56, 615-649). The G-protein-dependent signaling pathways are designated for amplifying and integrating a multiplicity of both stimulatory and inhibitory responses, and their importance in cell function is such that they are tightly regulated. PhLP (phosducin-like protein) is one of these regulatory elements; it belongs to the family of phosducins and its isoforms, proteins that bind the G protein beta/gamma subunits, thereby blocking their function (Lee et al., 1987, Biochemistry 26, 3983-3990; Miles et al., 1993, Proc. Natl. Acad. Sci. USA, 90, 10831-10835; Craft et al., 1998, Biochemistry 37, 15758-15772). It has been proposed that phosducin, strongly expressed in the photoreceptor cells of the retina (Lee et al., 1987, Biochemistry 26, 3983-3990; Wilkins et al., 1996, J. Biol. Chem., 271, 19232-19237) intervenes in the adaptation to light (Willardson et al., 1996, Proc. Natl. Acad. Sci. USA, 93, 1475-1479). In contrast, the function of PhLP is not as well understood; this protein is even more widely expressed (Miles et al., 1993, Proc. Natl. Acad. Sci. USA 90, 10831-10835) and also binds the G protein beta/gamma subunits with high affinity (Schröder and Lohse, 1996, Proc. Natl. Acad. Sci. USA, 93, 2100-2104; Thibault et al., 1997, J. Biol. Chem., 272, 12253-12256). It has been proposed that this protein represent a phosducin homologue that regulates a certain number of G-protein-dependent pathways in many types of cells (Savage et al., 2000, J. Biol. Chem., Vol. 275, 39, 30399-30407).

However, no role of PhLP has been described to date in the regulation of angiogenesis.

SRp75 belongs to the family of SR proteins due to the fact that it contains in the N-terminal position a conserved domain RRM (RNA recognition motif), a glycine-rich region, an internal region homologous with the RRM and a long (315 aa) C-terminal domain composed essentially of alternating serine and arginine residues (RS domain) (Zahler et al., Mol. Cell Biol. 1993 July; 13(7): 4023-8). The SR proteins constitute a family of nuclear phosphoproteins which are necessary for constitutive splicing but also influence the regulation of alternative splicing. The SR proteins have a modular structure (one or two RRM domains and one RS domain). Each domain in the SR proteins is a functional module. The coordinated action of the RRM domains determines their binding specificity to RNAs, whereas the RS domains function as splice activators (Cáceres et al. 1997, J. Cell Biol., 139, 225-238; Chandler et al., 1997, Proc. Natl. Acad. Sci. USA, 94, 3596-3601; Mayeda et al., 1999, Mol. Cell. Biol., 19, 1853-1863; Graveley and Maniatis, 1998, Mol. Cell, 1, 765-771). Various studies have suggested the unique functions in alternative splicing of the pre-mRNA for the particular SR proteins, especially since they are expressed differentially in a variety of tissues. These SR proteins are thus presented as crucial in the regulation of splicing during cell development and differentiation (Zahler et al., Science 1993 Apr. 9; 260 (5105): 219-222; Fu, 1993, Nature, 365 (6641): 82-8; Cáceres and Krainer, 1997 (ed. Krainer), Oxford University Press, Oxford, UK, pp. 174-212; Valcarcel and Green, 1996, Trends Biochem. Sci., 21(8): 296-301). A recent study showed a variable level of expression of SRp75 in different lymphoid cell lines (Dam et al., 1999, Biochim. Biophys. Acta; 1446(3): 317-33).

To date, no role in the regulation of angiogenesis has been described for either SFRS4 or SRp75 nor for the homologous protein of this factor.

Carboxypeptidase D (CPD of the S10 family of serine peptidases) is a transmembrane protein (180 kDa) which matures the proteins in the trans-Golgi network and notably the proteins secreted via the constitutive pathway such as the growth factors and their receptors: insulin receptor, insulin-like receptor of growth hormones (Reznik et al., 1998; J. Histochem. Biochem., 46, 1359). It is a carboxypeptidase with an activity identical to that of carboxypeptidase E (CPE-like) which is widely distributed in the tissues. The carboxypeptidases intervene in the elimination of basic amino acids from the C-terminal part of the peptide in order to generate either the bioactive product or the precursor for the formation of the C-terminal amide group (Fricker, 1988, Ann. Rev. Physiol., 50, 309-321; Fricker, 1991, (ed.) *Peptide Biosynthesis and Processing*, pp. 199-230, CRC Press, Boca Raton, Fla.).

CPD is constituted in humans by three carboxypeptidase-like domains, of one transmembrane domain and a small cytosol tail of 58 residues (Novikova et al., 1999, J. Biol. Chem., 274, 28887) capable of binding the phosphatase A protein (PP2A) (Varlamov et al., 2001, J. Cell Science, 114, 311). This is a highly conserved protein among the species with similar enzymatic properties.

CPD is expressed to a high degree in the human placenta. It is found notably in the endothelial cells, the trophoblasts, the amniotic epithelial cells, the chorionic endothelial villus cells and the smooth muscle vascular cells of umbilical cords (Reznik et al., 1998; J. Histochem. Cytochem., 46, 1359). CPE and CPD are also implicated in the production of the precursor of endothelin 1 (ET-1). This suggests that CPE and CPD are implicated in the production of certain umbilical and placental peptides having autocrine and/or paracrine functions.

To data there have been no descriptions of any regulatory role of the protein CPD in angiogenesis.

The protein USP9X belongs to the family of UBPs (ubiquitin proteases), a group of enzymes whose function is to invert the ubiquitination reaction by removing the ubiquitin residue from numerous substrates implicated in cell division, growth, differentiation, signaling or activation of transcription (Liu et al., 1999, Mol. Cell Biol., 4, 3029-38; Zhu et al., 1996, Proc. Natl. Acad. Sci. USA 93: 3275-3279; Verma et al., 1995, Genes Dev. 9: 2723-2735). The ubiquitination of the proteins is an important phenomenon in the regulation of the biological pathways such as transduction activated by cytokines (Baek et al., 2001, Blood, 98, 636-642). The UBPs are characterized by a conserved core domain with surrounding divergent sequences and more particularly to the N-terminal part enabling the specificity of the substrate. These N-terminal divergences can alter the localization and confer multiple functions on the different members of the large family of UBPs (Lin et al., 2001, J. Biol. Chem., 276(23): 20357-63). Certain specific proteases of ubiquitin have already been described or suggested as implicated in certain biological processes such as UBP109 in embryonic development (Park et al., 2000, Biochem. J., 349. 443-53), UBP43 in the differentiation of hematopoietic cells (Liu et al., 1999, Mol. Cell. Biol., 4, 3029-38). The ubiquitination pathway is implicated in angiogenesis (Ravi et al., 2000, 14, 34-44; Sutter et al., Proc. Natl. Acad. Sci. USA, 97, Issue 9, 4748-4753) but USP9X has not been described to date as a regulator of angiogenesis.

The sequence of this mRNA has a coding sequence from nucleotide 136 to nucleotide 3795. There was thus identified a protein GS-P22 resulting from the translation of this mRNA. This protein nardilysine is composed of 1219 aa. It is identified as number SEQ ID No. 74 in the attached sequence listing.

N-arginine dibasic convertase (NRD convertase; nardilysine; EC 3.4.24.61) is a metalloendopeptidase of the family of the insulinases that cleave specifically the peptides (particularly the neuroendocrine peptides such as somatosatin-28, dynorphine-A, the natriuretic atrial factor) on the N-terminal side of an arginine residue at the level of the dibasic sites in vitro (Cohen et al., 1995, Methods Enzymol., 248, 703-716; hospital et al., 1997, Biochem. J., 327, 773-779). Its exact function in vivo still remains poorly understood but many enzymes of the same family are implicated in the maturation of the prohormones and proproteins (Winter et al., 2000, Biochem. J., 351, 755-764). The NRD convertase activity is present principally in the endocrine tissues and to a majority degree in the testicles (Chesneau et al., 1994, J. Biol. Chem., 269, 2056-2061). It can be localized both in the cytoplasm and at the cell surface (Hospital et al., 2000, Biochem. J., 349, 587-597).

At present, there is limited knowledge regarding the regulation of the expression and activity of NRD convertase. The activity appears to be regulated by the amines that bind the acid domain (stretch) of the enzyme (Csuhai et al., 1998, Biochemistry, 37(11): 3787-94). It has also been shown that retinoic acid can modulate the expression of the enzyme in human neuroblast lines (Draoui et al., 1997, J. Neurooncol., 31, 99-106).

In the adult rat, the regulated expression of NRD convertase during spermatogenesis and its concentration in the flagellum suggests a role of this enzyme in the differentiation of male germinal cells (Chesneau et al., 1996, J. Cell Sci. 109, 2737-2745). It has also been proposed that this enzyme plays a specific role in neuronal development (Fumagelli et al., 1998, Genomics 47, 238-245). NRD convertase has recently been described as a new specific receptor of the heparin-binding EGF growth factor (HB-EGF) which controls cell migration (Nishi et al., 2001, EMBO J., 20(13): 3342-50).

In contrast, no role has been discovered to date for NRD1 in the regulation of angiogenesis.

The gene of acute lymphoblastic leukemia-1 (ALL)-1 or myeloid-lymphoid or mixed-lineage leukemia (MLL) or also designated human tri-thorax (HRX) on the human chromosome 11, band q23, is the site of many locally regrouped chromosome alterations (deletions, partial duplications, translocations) associated with various types of leukemia. The structurally variant proteins derived from the altered gene are presumed to cause the malignant transformation of the precursor hematopoietic cells (Nilson, Br. J. Haematol., 1996, 93(4): 966-72; Kobayashi et al., 1995, Leuk. Lymphoma, 17(5-6): 391-9).

The protein MLL is a large nuclear protein with zinc finger motifs and SET domain, highly conserved, of 200 aa localized in the C-terminal part. This protein is expressed to a high degree during embryogenesis; studies have shown that this protein is a positive regulator of the homeobox genes Hox (Yu et al., 1995, Nature (London) 378, 505-508). The protein MLL is described as being implicated in transcriptional maintenance in the development which functions in multiple morphogenetic processes (Yu et al., 1998, Vol. 95, Issue 18, 10632-10636). It has been suggested that the protein MLL plays a role in the regulation both of cell proliferation and survival in the developing embryo (Hanson et al., 1999, Proc. Natl. Acad. Sci. USA, 96, Issue 25, 14372-14377).

To date, there have been no descriptions of any role of the protein MLL in the regulation of angiogenesis.

Since its identification in 1995, the gene ATRX (synonyms XNP, XH2) has been shown to be the gene of numerous forms of diseases; different mental retardation syndromes associated with chromosome X are linked to the mutations of this gene. (Review: Gibbons and Higgs, 2000, Am. J. Med. Genet., 97(3): 204-212.) This gene codes for a protein of the subgroup SNF2 of the superfamily of the helicases and ATPases (Picketts et al., 1996, Hum. Mol. Genet. 5 (12): 1899-907); these domains suggest that the protein ATRX has a role in transcriptional regulation via an effect on the structure and/or the function of chromatin, but its exact role still remains unknown. No role in the regulation of angiogenesis has been described to date.

The transporter of CMP-sialic acid is implicated in the process of maturation of glycosylation and more particularly of sialyation; it enables the translocation of cytosolic CMP-sialic acid through the membrane of the Golgi apparatus required for the sialyation of the membrane or secreted proteins as well as the lipids in this compartment. (Hirschberg and Snider, 1987, Ann. Rev. Biochem., 56, 63-88; Hirschberg, 1996, in *Organellar Ion channels and Transporters, Society of General Physiologists, 49th Annual Symposium* (Clapham, D. E. and Ehrlich, B. E., eds.), pp. 105-120, Rockefeller University Press, New York). The regulation of the transport of CMP-sialic acid is still poorly understood although an augmentation of sialyation was observed at the surface of tumor cells (Santer et al., 1989, Eur. J. Biochem., 181, 249-260; Saitoh et al., 1992, J. Biol. Chem., 267, 5700-5711; Bresalier et al., 1996, Gastroenterology, 110, 1354-1367; Gorelik et al., 1997, Cancer Res., 57, 332-336) and that the inhibition of the CMP-sialic acid transporter reduces the growth and metastases of tumor cells (Harvey, B. E. and Thomas, P. (1993) Biochem. Biophys. Res. Commun. 190, 571-575). However, to date, no implication of this transporter in the regulation of angiogenesis has been reported.

Cbl-b belongs to the Cbl family, highly conserved among the species. The Cbl proteins are characterized in their N-terminal part by a putative domain binding phosphotyrosines and a RING FINGER motif in the C-terminal part, the Cbl proteins of mammals containing a proline-rich region, conserved tyrosine residues and a zipper leucine motif. The Cbl proteins participate in the signaling of the proteins of the tyrosine kinase receptors as well as the antigens and receptors of cytokines by associating them at their cytoplasm tail providing the continuity of the signal of these receptors. The protein Cbl is recruited by the tyrosine kinase module of these receptors and the phosphorylated tyrosines after cell activation. Cbl functions as a docking protein and associates itself with molecules containing the domains SH2 and SH3, including the family of the adapters Crk and Vav. It has been proposed that the Cbl proteins are negative regulators of the signaling of the tyrosine kinase receptors (Smit et al., Crit. Rev. Oncog. 1997; 8:359-79) as well as positive modulators of the signalization of receptors such as the superfamily of the TNF receptors (Arron et al., J. Biol. Chem. 2001 Aug. 10; 276: 30011-7).

The protein Cbl-b, expressed at high levels in many tissues and cells including the hematopoietic cells (Keane et al., Oncogene 1995 Jun. 15; 10(12): 2367-77) is implicated in the installation of the lymphocyte activation threshold (Bachmaier et al., Nature 2000, 403: 211-6; Fang et al., J. Biol. Chem. 2001; 276: 4872-8). The regulatory subunit P85 of phosphatidylinositol 3-kinase (P13K) was identified as being its substrate. Cbl-b, by its ligase activity of the protein ubiquitin E3, negatively regulates this regulatory subunit P85 (Fang D, Nat. Immunol. 2001 September; 2(9): 870-5). Cbl-b is also a negative regulator of the signalization of the receptor of the epidermal growth factor, EGFR (Ettenberg et al., Oncogene 1999; 18: 1855-66; Ettenberg et al., J. Biol. Chem. 20011 276: 27677-84).

In contrast, there have been no descriptions to date that Cbl-b plays a role in the regulation of angiogenesis.

The base chromatin unit in eukaryotes is the nucleosome. A nucleosome is constituted by a 146-bp DNA sequence wound around an octamer of proteins, the histones H2A, H2B, H3, H4 (Luger et al., 1997, Nature, 389, 251-260). The heterogeneity in the structure of nucleosomes can be a transcriptional regulation mechanism. This heterogeneity is created either by post-translational modifications of the histones such as acetylation, phosphorylation, methylation, ubiquitination (Mizzen et al., Cold Spring Harb. Symp. Quant. Biol. 1998; 63: 469-81; Workman and Kinston, 1998, Ann. Rev. Biochem., 67: 545-579) or by the incorporation of histone variants in the nucleosome. The different histone variants enable the specialization of the structure of the nucleosome for specific purposes; the specific histone variants of sperm, for example, facilitate the dramatic compaction of DNA which occurs during spermatogenesis (Wolffe, 1998, *Chromatin: Structure and Function,* 3$^{rd}$ Ed., Academic Press, San Diego; Doenecke et al., 1997, Adv. Exp. Med. Biol., 424, 37-48).

The histone H2A.F/Z is a family of variants of the histone H2A which is highly conserved across the species and substantially divergent from the histone H2A of phase S in given species (Jackson et al., 1996, Trends Biochem. Sci., 221, 466-467; Jiang et al., 1998, Biochem. Biophys. Res. Commun., 245, 613-617). The exact function of H2A.F/Z is still unknown but this histone could play a role in transcriptional regulation because in *Tetrahymena* its expression is associated with the transcriptionally active micronucleus and in *Drosophila* its incorporation in the chromatin during development coincides with the beginning of the expression of the zygote gene (Clarkson et al., 1999, DNA Cell Biol., 18, 457-462; Stargell et al., 1993, Genes Dev., 7, 2641-2651).

In contrast, no role is known for the histone H2A.F/Z to date in the regulation of angiogenesis.

Casein kinase II (CKII) is a ubiquitous serine/threonine kinase which is localized both in the cytosol as well as in the nucleus of eukaryote cells. CKII phosphorylates more than one hundred substrates, many of which are implicated in the control of cell division and in the transduction of the signal (review: Allende and Allende, 1995, The FASEB Journal, Vol. 9, 313-323). CKII exists in a tetramer form composed of two alpha and/or alpha' catalytic subunits and two regulatory subunits (beta). The beta subunits appear to act so as to stabilize the alpha and/or alpha' subunits and also influence the specificity of the substrate and the kinetic properties of the enzyme (Dobrowolska et al., 1999, Mol. Cell. Biochem., 191(1-2): 3-12). Certain studies have shown that the activity of casein kinase is stimulated by growth hormones or factors such as insulin, IGF-I, EGF (Sommercorn et al., 1987, Proc. Natl. Acad. Sci. USA, 84, 8834-8838; Klarlund et al., 1988, J. Biol. Chem., 263, 1872-1875; Ackerman and Osheroff, 1989, J. Biol. Chem., 264, 11958-11965), this activation resulting from an augmentation of the phosphorylation of the beta subunit of casein kinase (Ackerman et al., 1990, Proc. Natl. Acad. Sci. USA, 87, 821-835). Various studies have shown a deregulated expression of CKII in tumors. Recent studies have demonstrated that the overexpression of CKII in tumor cells is not solely a reflection of the proliferation of the tumor cells but also it can reflect the pathobiological characteristics of the tumor. The deregulation of CKII could influence the apoptotic activity of these cells (review: Tawfic et al., 2001, Histol. Histopathol., 16(2): 573-82). This enzyme is described as having a possible role in oncogenesis (Yu et al., J. Cell. Biochem., 1999, 74(1): 127-34).

In contrast, no differential expression of CKII or of its beta subunit during angiogenesis has been described nor has a role in the regulation of angiogenesis been demonstrated to date.

Described recently, hemicentine is a protein of the extracellular matrix of the immunoglobulin superfamily which is implicated in cell attachment and migration on the basal membrane (Vogel et Hedgecock, 2001, Development, 128 (6): 883-94). Its role in the regulation of angiogenesis has not been described to date. This protein contains the sequence of fibulin-6 which belongs to the fibulin family, proteins of the extracellular matrix and of the blood, the two members of which that have been the most extensively studied are fibulin 1 and fibulin 2 (Alexande and Detwiler, 1984, Biochem. J., 217, 67-71; Argraves et al., 1990, J. Cell Biol., 111, 3155-3164; Kluge et al., 1990, Eur. J. Biochem., 193, 651-659; Pan et al., 1993, J. Cell Biol., 123, 1269-1277). They interact with the proteins implicated in cell adhesion such as fibronectin, laminin and fibrinogen (Brown et al., 1994, J. Cell Sci., 107 (Pt. 1), 329-38; Tran et al., 1995, J. Biol. Chem., 270(33): 19458-64; Godyna et al., 1995, Matrix Biol., 14(6): 467-77) or endostatin which is an inhibitor of angiogenesis (Sasaki et al., 1998, EMBO J., 17(15): 4249-56) which confers on them a regulatory function in various biological processes. Fibulin 1, for example, has been described as possibly playing a role in the regulation of the neurotrophic activity of the protein precursor amyloid beta (Ohsawa et al., 2001, J. Neurochem.; 76(5): 1411-20), in homeostasis and thrombosis (Tran et al., 1995, J. Biol. Chem., 270(33)L 19458-64).

In contrast, the function of fibulin 6 remains poorly understood and, in particular, no role of this protein has been described to date in the regulation of angiogenesis.

The protein Syne-2 is poorly understood; it was recently described with a homologous protein, the protein Syne-1 (synaptic nuclear envelope-1). The protein Syne-1 is associated with the nuclear envelopes in the cells of smooth, cardiac and skeletal muscle. Syn-1 is described as the first protein found to be associated selectively with the synaptic nucleus and it has been suggested that it is implicated in the formation or maintenance of nuclear aggregates in the muscle junction (Appel et al., 2000, J. Biol. Chem., Vol. 275, Issue 41, 31986-31995). Syn-2 differs from Syn-1 in its distribution and in its level of expression which is weaker. The two homologous proteins exhibit repeated spectrin domains which are present in different proteins implicated in the structure of the cytoskeleton (Yan et al., Science 1993 Dec. 24; 262(5142): 2027-30).

No role of Syn-2 in the regulation of angiogenesis has been described to date.

The gene seladin-1 was recently identified in the human brain. Seladine-1 appears to be an important factor for the protection of cells against the toxicity of the beta-amyloid peptide and oxidative stress (Greeve et al., 2000, J. Neuroscience, 20(19): 7345-7352). These authors suggest that seladine-1 could be implicated in the regulation of survival and cell death and that the diminished expression of this protein in specific neurons could be the cause for the selective vulnerability in Alzheimer's disease.

In contrast, no role in the regulation of angiogenesis has been described to date for seladine-1.

The protein CHD2 belongs to the family of CHD proteins characterized by a chromodomain. The "chromo" (CHRomatin Organization MOdifier) domain is a conserved region of circa 60 amino acids found in a variety of proteins including the HP1 proteins of *Drosophila melanogaster*, which is linked to heterochromatin; 4 genes of these family have been identified in the human genome: CHD1, CHD2, CHD3 and CHD4 (Woodage et al., 1997, 94, 11472-11477). Chromodomain confers on the protein a role in the compaction of chromatin (Paro, 1990, Trends Genet. 6: 416-421; Singh et al., 1991, Nucleic Acids Res. 19: 789-794; Aasland and Stewart, 199, Nucleic Acids Res. 23: 3168-3173; Koonin et al., 1995, Nucleic Acids Res. 23: 4229-4233; Messner et al., 1992, Genes Dev., 6, 1241-1254; James and Elgin, 1986, Mol. Cell. Biol. 6, 3862-3872). The CHDs contain a second conserved domain, the domain Myb which is implicated in the binding with DNA (Klempnauer and Sippel, 1987, EMBO J., 6: 2719-2725). In addition to these domains, CHD2 contains the domain SNF2, found in the proteins implicated in a variety of processes such as the regulation of transcription (e.g.: SNF2, STH1, brahma, MOT1), repair of DNA (e.g.: ERCC6, RAD16, RAD5), recombination of DNA (e.g., RAD54) (review: Eisen et al., 1995, Nucleic Acids Res., 23(14): 2715-23) and lastly a conserved domain of the helicase superfamily, the "DEAH box helicases". The helicases are implicated in the unwinding of nucleic acids (Matson and Kaiser-Roger, 1990, Ann. Rev. Biochem. 59, 289-329). It was proposed that the "DEAH box" helicases were implicated in the splicing of mRNAs and in the progression of the cell cycle (Ludgren et al., 1996, Mol. Biol. Cell 7, 1083-1094; Imamura et al., 1998, Nucleic Acids Res., 26(9): 2063-8).

The CHDs could play an important role in the regulation of the transcription of genes (Delmas et al., 1993, Proc. Natl. Acad. Sci., 90, 2414-2418; Woodage et al., 1997, Proc. Natl. Acad. Sci. USA, 94, 11472-11477; Tran et al., 2000, The EMBO Journal, 19, 2323-2331).

A recent study showed that CHD4 is induced when endothelial cells are stimulated by TNF-alpha (Murakami et al., 2000, J. Atheroscler. Thromb.; 7(1): 39-44).

No studies have demonstrated an implication of CHD2 in the regulation of angiogenesis.

The role of the protein BRD2 is unknown. This protein is characterized by two bromo domains. The bromo domain is a conserved region, first identified as a signature of 61-63 amino acids; its function being unknown (Haynes et al., Nucl. Acids Res., 1992, 20, 2603). This domain was subsequently identified in transcription factors, co-activators and other proteins are implicated in the transcription or remodeling of chromatin and its boundaries were extended to 110 amino acids. The increasing number of proteins containing this domain is more than forty (Jeanmougin et al., 1997, Trends Biochem. Sci. 22, 151-153; Winston and Allis, 1999, Nature Struct. Biol. 6, 601-604). Certain proteins have a single copy of the domain while others present two copies of the motif. The protein BRD2 is characterized by two bromo domains which is also the case of the transcription factors BDF1 (Tamkun, 1995, Curr. Opin. Genet. Dev., 5: 473-477) or the protein TAFII250, the largest subunit of the multiprotein complex TFIID implicated in the initiation of transcription (Jacobson et al., 2000, Science, 288(5470): 1422-5). The exact function of this domain remains unknown but it is thought to be implicated in protein-protein interactions and could be important for the assembly or the activity of multiple complex components implicated in the modification of chromatin and the transcriptional control of a large variety of eukaryote genes included those which control growth. A large variety of functions directed on chromatin, including but not limited to phosphorylation, acetylation, methylation, coactivation or transcriptional recruitment characterize the complexes which contain the bromo domains. Their versatility and ubiquity provides diverse, rapid and flexible transcriptional responses (review: Denis, 2001, Frontiers in Bioscience 6, d849-852).

The differential expression of proteins containing a bromo domain has already been demonstrated, notably that of a protein homologous to RING3 kinase whose expression is induced by VEGF or bFGF in endothelial cells. It has been suggested that this protein is a new target of the signalization pathway activated by VEGF and bFGF which enables endothelial cells to enter into the proliferative phase of the angiogenesis process (BelAiba et al., 2001, Eur. J. Biochem., 268 (16): 4398-407).

In contrast, there have been no reports of BRD2 being implicated in the regulation of angiogenesis.

Syntaxin 3A belongs to the family of syntaxins/epimorphines which are characterized by a size between 30 and 40 kDa, a highly hydrophobic C-terminal end which is probably implicated in the anchoring of the protein in the membrane and a well conserved central region which appears to be in a coiled-coil conformation. The specific profile of this family is based on the most highly conserved region of the coiled-coli domain. The syntaxins are implicated in the intracellular transport of vesicles and their storage in the plasma membrane. Recent studies suggest that different syntaxin isoforms could interact with a defined group of membrane transport proteins and thereby regulate their transport activity (review: Saxena et al., 2000, Curr. Opin. Nephrol. Hypertens., 9(5): 523-7).

Syntaxin 3A is one of the two isoforms (3A and 3B) identified in humans, stemming from an alternative splicing of the same gene. Augmentation of the expression of syntaxin 3A has already been demonstrated over the course of various biological processes such as the neutrophil differentiation of HL-60 cells or in dentate granule cells during the propagation of synaptic plasticity in the nervous system (Rodger et al., 1998, J. Neurochem., 71(2): 666-675; Martin-Martin et al., 1999, J. Leukoc. Biol., 65(3): 397-406).

In contrast, no increased expression of syntaxin has been reported to date in the course of angiogenesis and thus no implication in the regulation of angiogenesis.

Sharp (SMART/HDAC1 Associated Repressor Protein) is a recently isolated gene (Nagase et al., 1999, DNA Res., 6(1):

63-70). SHARP is a potential repressor of transcription whose repression domain (RD) interacts directly with SMRT and at least 5 members of the NuRD complex (nucleosome remodeling and histone deacetylase activities) including the deacetylase histones HDAC1 and HDAC2. SHARP moreover binds to the ARS coactivator of the RNA of the steroid receptor by an intrinsic domain binding RNA and suppresses the transcription activity of the steroid receptor. In this manner, SHARP has the capacity to modify both the bound and unbound nuclear receptors. The expression of SHARP is itself inducible by steroids, suggesting a simple feedback mechanism for the attenuation of the hormonal response (Shi et al., Genes Dev. 2001 May 1; 15(9): 1140-51. The deacetylase histones (HDAC) were shown to be implicated in the induction of angiogenesis by suppressing the expression of the tumor-suppressor genes (Kim et al., 2001, Nat. Med., 7(4): 437-43).

Nevertheless, no role of the SHARP protein has been described in the regulation of angiogenesis.

The exact role of the proliferation potential-related protein identified is still unknown. It presents as its homologous proteins zinc finger domains known to be implicated in protein-protein interactions. This protein is homologous with a member of the family of the retinoblastoma-binding proteins (pRb), retinoblastoma-binding protein 6, also referred to as RBQ-1 (Sakai et al., 1995, Genomics, 30(1): 98-101). The protein pRb (suppressor of the retinoblastoma tumor) acts for controlling cell proliferation, inhibits apoptosis and induces cell differentiation and does this by associating with a large number of proteins (review: Morris and Dyson, 2001, Adv. Cancer Res.; 82: 1-54).

The proliferation potential-related protein has never been described to date as implicated in the regulation of angiogenesis.

The protein HIP1 (Huntingtin interacting protein 1) is a protein of 116 kDa that binds the protein.

Huntingtin, product of the mutated gene in Huntington's disease (Kalchman et al., 1997, Nat. Genet., 16, 44-53; The Huntington's Disease Collaborative Research Group, 1993, Cell 72, 971-983). HIP1 is predominantly expressed in the brain but is also detected in other tissues (Wanker et al., 1997, Human Molecular Genetics, Vol. 6, 487-495). The function of HIP1 is not yet fully understood but it shares the biochemical characteristics and conserved domains with Sla2p, a protein essential for the function of the cytoskeleton in *Saccharomyces cerevisiae* (Kalchman et al., 1997, Nat. Genet. 16, 44-53; Holtzman et al., 1993, J. Cell Biol. 122, 635-644). HIP1 also contains a leucine zipper domain and is homologous in its C-terminal part with taline, cytoskeleton protein implicated in cell-substratum and cell-cell interactions (Rees et al., 1990, Nature; 347(6294): 685-9). It has recently been shown that the protein HIP1 is implicated in apoptosis (Hackam et al., 2000, J. Biol. Chem., Vol. 275, Issue 52, 41299-41308).

No role of HIP1 in angiogenesis has been described to date.

Nucleoporin 88 (Nup88) is a protein of the nuclear membrane probably implicated in nucleocytoplasmic transport (Formerod et al., 1997, EMBO J., 16: 807-816; Fomerod et al., Oncogene 1966, 13: 1801-1808). Nup88 was found to be associated with the central domain of CAN/Nup214, a component of the complex of a nuclear pore probably implicated in the importation of nuclear proteins, the exportation of nuclear mRNAs and the regulation of the cell cycle (van Deursen et al., 1996, EMBO J., 15: 5574-5583). Nup88 has been shown to be widely distributed and overexpressed in cancerous and fetal cells and tissues (Martinez et al., 1999, Cancer Research 59, 5408-5411; Gould et al., 2000, American Journal of Pathology, 157: 1605-1613).

Nup88 to date has never been described as implicated in the regulation of angiogenesis.

The FKBPs (FK506 binding proteins) are major proteins binding the immunosuppressive drug FK506 with high affinity in vertebrates (1990, Tropschug et al., Nature 346: 674-677; Stein, 1991, Curr. Biol. 1: 234-236; Siekierka et al., 1990, J. Biol. Chem. 265: 21011-21015). Many members of the FKBP family have been identified in various tissues and various cellular compartments, the best known being FKBP12, a cytoplasm isoform (Galat and Metcalf, 1995, Prog. Biophys. Mol. Biol. 63, 67-118; Kay, 1996, Biochem. J. 314, 361-385). The FKBPs belong to a large family cis-trans peptidyl propyl isomerases (PPIase or rotamase). PPIase is an enzyme that accelerates the folding of the protein by catalyzing the cis-trans isomerization of the peptide bonds involving the proline residue (Fischer and Schmid, 1990, Biochemistry 29: 2205-2212). The FKBPs are known to be implicated in many cellular processes such as cellular signaling, protein transport and transcription. Studies of interruption of the gene coding for the FKBPs in plants and animals have emphasized the importance of this family of proteins in the regulation of cell division and differentiation (review: Harrar et al., 2001 Trends Plant Sci.; 6: 426-331). However, despite the fact that they bind surface receptors and despite their Ppiase activity, their physiological function has yet to be defined. It was recently proposed that the Ppiases play a role in the functional rearrangement of the components in the heterocomplex receptors (Schiene-Fisher and Yu, 2001, FEBS Lett., 495(1-2): 1-6).

It has not been claimed to date that the FKBP proteins are implicated in the regulation of angiogenesis.

The complementary DNA (cDNA) of the SALF protein (stoned B/TFIIA-alpha/beta-like factor) was recently identified from a bank of cDNA originating from the human placenta (Ashok et al., 1999, J. Biol. Chem., Vol. 274, Issue 25, 18040-18048). The role of SALF has yet to be identified but this cDNA, characterized as rare, is identical to the sequence of the ALF protein with a more extended N-terminal sequence containing a domain homologous to the Stone B protein of *Drosophila* (Andrewe et al., 1996, Genetics 143, 1699-1711) and to the adaptor proteins of *Clathrina*, $\mu_1$ (AP47) and $\mu_2$ (AP50) (Thurieau et al., 1988, DNA (NY) 7, 663-669; Nakayama et al., 1991, Eur. J. Biochem. 202, 569-674). The protein ALF (TFIIA-alpha/beta-like factor) is also a new factor which is a functional homolog of the transcription factor TFIIA alpha/beta which, with the factor TFIIA gamma, can stabilize the interactions of the element TBP (TATA-binding protein)-TATA and maintain the in vitro transcription dependent of RNA polymerase II. The protein ALF is described as a general transcription factor specific of the testicles (Ashok et al., 1999, J. Biol. Chem. Vol. 274, Issue 25, 18040-180048).

The domain of Stoned B/clathrin AP-like homology of SALF also reveals a potential function in the dependent transport of clathrin in the membrane proteins.

Chen et al. (2001, Biochem. Biophys. Res. Commun. 23; 281(2): 475-482) showed that the gene of the factor SALF is induced by retinoic acid (or the retinoids) in cultured smooth muscle cells.

In contrast, no implication of SALF in the regulation of angiogenesis has been reported to date.

The recently described protein P29 interacts with the protein GCIP (Grap2 cyclin-D interacting protein), itself interacting with cyclin D and the protein Grap2 (Chang et al., Biochem. Biophys. Res. Commun. 2000 Dec. 20; 279(2): 732-7). Grap2 is an adaptor protein specific of the leukocytes of the immune tissues (Qiu et al., 1998, Biochem. Biophys. Res. Commun. 253, 443-447). The adaptor proteins play an essential role in the formation of intracellular signalization complexes relaying the extracellular signals from the plasma membrane to the nucleus of the cell. Grap2 is a central linking protein in the signalization and activation of the immune cells. The type D cyclins respond to the extracellular mitogenic signals (Sherr, 1993, Cell 73, 1059-1065). The protein GCIP, which is expressed in a ubiquitous manner in all human tissues, interacts with Grap2 and the D cyclins. Its expression regulates the phosphorylation of the retinoblastoma (Rb) protein and thereby the transcription pathway controlled by the transcription factor E2F1 belonging to a family of factors that play a major role in the proliferation, differentiation, apoptosis and progression of the cell cycle (Nevins, 1998, Cell Growth Differ. 9, 585-593; Chellappan et al., 1998, Curr. Top. Microbiol. Immunol. 227, 57-103; Dyson, 1998, Genes Dev. 12, 2245-2262). It has therefore been suggested that GCIP plays a role in the control of cell proliferation and differentiation via the signalization pathways controlled by the Grap2 and cyclin D proteins (Xia et al., 2000, J. Biol. Chem., 275 (27): 20942-8). The protein P29 which has been localized in the nucleus and is present in multiple tissues has been found to be associated with GCIP and therefore could be implicated in the functional regulation of GCIP (Chang et al., Biochem. Biophys. Res. Commun. 2000 Dec. 20; 279(2): 732-7).

The protein P29 thus appears to play a role in the signaling pathways implicated in cell proliferation and differentiation. However no role in the regulation of angiogenesis has been demonstrated to date either for the protein P29 or for the identified homologous protein.

The gene of TMEM2 has recently been described (Scott et al., Gene 2000; 246(1-2): 265-74); based on its structure, it was suggested that the coded protein TMEM2 was transmembranous. The presence of the RGD motif suggesting a role in cellular adhesion is an implication in the cellular signalization pathways.

No role has been described to date for this protein and in particular no role in the regulation of angiogenesis has been demonstrated.

Although few studies to date have focused on the protein called Dorfin, its gene was recently identified. This gene is ubiquitously expressed in many organs. It binds specifically to the conjugating ubiquitin enzymes, UbCH7 and UbCH8, via its RING-FINGER/IBR domain. Dorfin is proposed as a new member of the RING Finger type ubiquitin ligases. This protein is localized in the centrosome and probably acts in the organization centers of the microtubules (Niwa et al., 2001, Biochem. Biophys. Res. Commun., 281(3): 706-13). No differential expression of Dorfin nor a role in the regulation of angiogenesis have been reported to date.

The protein TM4SF2 belongs to the type 4 transmembranous superfamily certain of whose members are known to be implicated in angiogenesis such as CD9 and PETA-3/CD151 (Klein-Soyer et al., 2000, Arterioscler. Thromb. Vasc. Biol., 20: 360-9; Sincock et al., 1999, J. Cell. Science, 112, 833-844). In contrast the function of TM4SF2 remains unknown. This protein is homologous with the protein TALLA-1, proposed as a specific surface marker of neuroblastomas and neuroblastic leukemia (Takagi et al., Int. J. Cancer, 1995, 61(5): 706-15).

No role for the protein TM4SF2 in angiogenesis has been reported to date.

The ecto-ATPases (ATPases of the cell surface) are enzymes that are ubiquitous in the cells that hydrolyze extracellular ATP and ADP into AMP (review: Plesner, 1995, Int. Rev. Cytol., 158: 141-214). The presence of the ATPDases was demonstrated in the aortic endothelial cells and the smooth muscle cells and described as possibly playing a regulatory role in homeostasis and platelet reactivity by hydrolyzing ATP and ADP (Robson et al., 1997, J. Exp. Med., 185(1): 153-163). Vascular ATPDase is closely homologous to the glycoprotein CD39 whose accession number in the GENBANK database is S73813 and which is identified by the number SEQ ID No. 290 in the attached sequence listing, activation antigen of lymphoid cells, also expressed by human endothelial cells (Kaczmarek et al., 1996, J. Biol. Chem., 271, 51, 33116-33122). Recently, Goepfert et al. (2001, Circulation, no. 104 (25): 3109-3115), implanting bodies containing Matrigel in mutant mice characterized by deficiency of expression of CD39, showed the absence of formation of neovessels around the implanted bodies. These observations led the authors to suspect a role for CD39 in the angiogenesis phenomenon. However, the experimentation described supports a poorly defined role of CD39 in angiogenesis rather than a direct and incontestable role. In fact, due to the fact that mutant mice deficient in CD39 exist, it is possible that embryos of CD39-deficient mice could develop. However, without angiogenesis there is no possible embryonic development. Consequently, either CD39 has a role in angiogenesis and therefore there would not exist viable CD39-deficient mutant mice, or CD39 has no role in angiogenesis. In another article, Goepfert et al. (2001, Circulation, 104 (25): 3109-15) did not demonstrate the absence of expression of CD39 in the mutant mouse endothelial cells employed.

In sum, the study by Goepfert et al. (2001, Circulation, 104(25): 31309-15) does not provide proof of any role of CD39 in angiogenesis.

Control of angiogenesis thus represents a strategic axis, both for basic research (in order to improve our comprehension of numerous pathological phenomena linked to angiogenesis) and for the development of new therapies intended for treating pathologies linked to angiogenesis.

In order to control angiogenesis, many pharmaceutical groups have developed therapeutic strategies based directly on the use of paracrine signals as stimulatory and inhibitory factors as agents for promoting or inhibiting angiogenesis. These strategies are based essentially on the use of these factors in their polypeptide form as stimulatory or inhibitory agents of angiogenesis, or more recently in the form of expression vectors coding for the selected factors.

SUMMARY OF THE INVENTION

This invention relates to a pharmaceutical composition including a pharmaceutically acceptable carrier and an at least one active agent selected from the group consisting of (i) a nucleic acid molecule of a gene of an endothelial cell, the expression of which is induced by an angiogenic factor and inhibited by an angiostatic agent; (ii) a complementary sequence or a fragment or derivative of the nucleic acid molecule of (i); (iii) a polypeptide sequence coded by the nucleic acid molecule of (i) or (ii); (iv) an antisense nucleic acid molecule that inhibits the expression of a nucleic acid molecule according to (i); and an antibody that binds to a polypeptide sequence according to (ii).

This invention also relates to an antibody that has an affinity for one of the polypeptide sequences identified by SEQ ID No. 54 to SEQ ID No. 102 or SEQ ID No. 291 to SEQ ID No. 297, or fragments or derivatives thereof.

This invention further relates to a method for the preparation of an antibody that has an affinity for one of the polypeptide sequences identified by SEQ ID No. 54 to SEQ ID No. 102 or SEQ ID No. 291 to SEQ ID No. 297, or fragments thereof, including immunizing an immunocompetent cell of an animal in vivo or in vitro with at least one polypeptide sequence identified by SEQ ID No. 54 to SEQ ID No. 102 or SEQ ID No. 291 to SEQ ID No. 297.

This invention still further relates to a pharmaceutical composition including one or more antibodies that have an affinity for one of the polypeptide sequences identified by SEQ ID No. 54 to SEQ ID No. 102 or SEQ ID No. 291 to SEQ ID No. 297, or fragments or derivatives thereof and a pharmaceutically acceptable carrier.

This invention further still relates to an antisense nucleotide sequence including at least 10 nucleotides selected from the set of sequences identified by the numbers SEQ ID No. 1 to SEQ ID No. 53, SEQ ID No. 225 and SEQ ID No. 284 to SEQ ID No. 288.

This invention also further relates to a mammalian expression vector including at least one antisense sequence.

This invention again relates to a mammalian expression vector including at least one nucleotide sequence selected from among the set of sequences identified by the numbers SEQ ID No. 1 to SEQ ID No. 53, SEQ ID No. 225 and SEQ ID No. 284 to SEQ ID No. 290.

This invention yet again relates to a method for the preparation of a genetically modified cell underexpressing a gene implicated in an angiogenic disorder, comprising inserting into a mammal cell a vector including at lest one antisense sequence.

This invention also again relates to a genetically modified cell that overexpresses at least one gene implicated in angiogenesis, wherein the at least one gene is selected from among the set of sequences identified by the numbers SEQ ID No. 1 to SEQ ID No. 53, SEQ ID No. 225 and SEQ ID No. 284 to SEQ ID No. 290, or fragments or derivatives thereof.

This invention further again relates to a method for the diagnosis or prognosis of an angiogenic pathology in a mammal, comprising the steps of detecting in vitro in the cells of the mammal the overexpression or underexpression of one or more nucleotide sequences selected from the set identified by the numbers SEQ ID No. 1 to SEQ ID No. 53, SEQ ID No. 225 and SEQ ID No. 284 to SEQ ID No. 290.

This invention still further again relates to a method for the diagnosis or prognosis of an angiogenic pathology in a mammal, comprising of detecting in vitro in the cells of the mammal the overexpression or underexpression of one or more polypeptide sequences identified by the numbers SEQ ID No. 54 to SEQ ID No. 102, or SEQ ID No. 291 to SEQ ID No. 297.

This invention also further again relates to a method for the verification of the therapeutic efficacy of an angiogenic treatment in a mammal, comprising identifying in vitro in a cell population of the mammal the overexpression or underexpression of at least one gene implicated in an angiogenic disorder identified by the numbers SEQ ID No. 1 to SEQ ID No. 53, SEQ ID No. 225 and SEQ ID No. 284 to SEQ ID No. 290.

This invention also yet again relates to a method for screening for compounds useful in the treatment of an angiogenic disorder of a mammal, comprising the steps of a) detecting expression of one or more nucleotide sequences selected from the set identified by SEQ ID No. 1 to SEQ ID No. 53, SEQ ID No. 225 and SEQ ID No. 284 to SEQ ID No. 290 in a first mammalian cell population contacted with a test compound; b) detecting expression of one or more of the nucleotide sequences in a second reference cell population whose angiogenic state is known; and c) identifying differences in the level of expression of one or more of the nucleotide sequences in the first and second cell populations, wherein differences in expression of the nucleotide sequences indicates the test compound has a therapeutic effect on an angiogenic disorder.

This invention then also relates to a device including a support, wherein the support comprises one or more specific probes of one or more nucleotide sequences selected from the set identified by the numbers SEQ ID No. 1 to SEQ ID No. 53, SEQ ID No. 225 and SEQ ID No. 284 to SEQ ID No. 290, or fragments or derivatives thereof.

This invention then again relates to a kit for the measurement of the differential display of genes implicated in angiogenic disorders, including a device including a support, specific primers and accessories required for (i) amplification of nucleotide sequences extracted from a sample; (ii) hybridization of the amplified nucleotide sequences with probes of the device; and (iii) performance of differential display measurements.

DETAILED DESCRIPTION OF THE INVENTION

Figure 1:
FIG. 1 is a photomicrograph of a human endothelial cell culture showing capillary tube formation upon transfection of cells with expression vectors 1A) GS-V1; 1B) GS-V2; 1C) GS-V4; 1D) GS-V5; 1E) GS-V15; and 1F) empty (control) vector.
Figure 1:
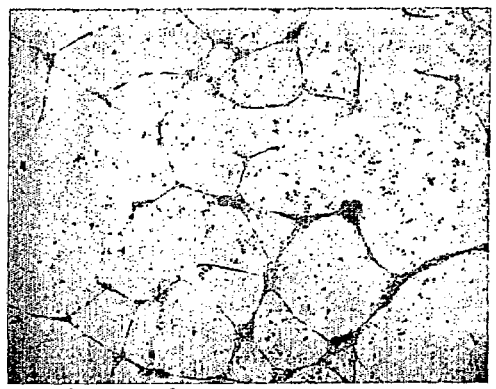
Figure 1:
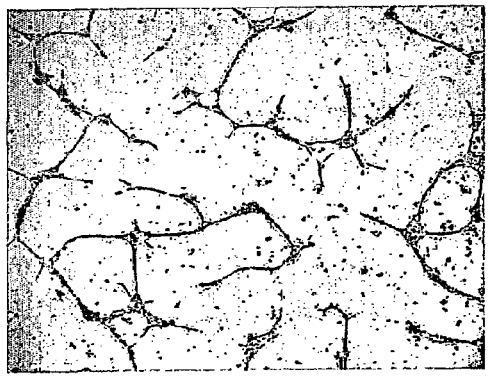
Figure 1:
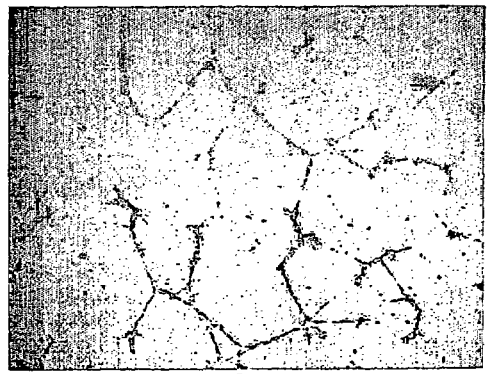
Figure 1:
Figure 1:
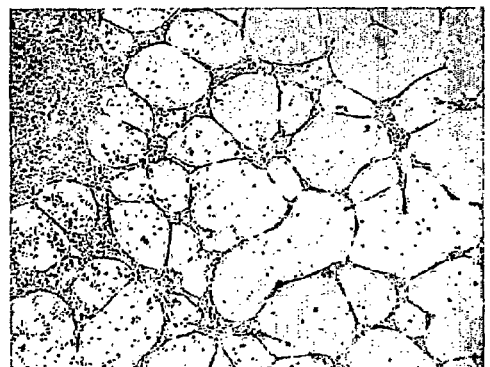

The instant application contains a "lengthy" Sequence Listing which has been submitted via CD-R in lieu of a printed paper copy, and is hereby incorporated by reference in its entirety. Said CD-R, recorded on Sep. 30, 2004, are labeled "Copy 1" and "Copy 2", respectively, and each contains only one identical 1.19 MB file (BMA41206.APP).

A method for the identification of new genes implicated in the regulation of angiogenesis has been developed. This method was the object of a French patent application published as FR no. 2798674 and of an International patent application published as WO 01/218312, the entire disclosures of which are herein incorporated by reference. This method has the distinctive characteristic of faithfully translating the innermost mechanisms regulating angiogenesis, taking into account all of the extracellular factors described as regulatory agents of angiogenesis; i.e., the angiogenic factors and angiostatic factors as well as the different components of the extracellular matrix. This method consists of bringing to bear these different extracellular factors via four clearly defined experimental conditions, in which endothelial cells are cultured on a component and/or on a clearly defined mixture of multiple components of the extracellular matrix and placed under the four experimental conditions, i.e.:

A control condition in which the endothelial cells are not stimulated.

An angiogenic condition in which the endothelial cells are stimulated by one or more angiogenic factors.

An angiogenesis inhibition condition in which the endothelial cells are stimulated by one or more angiogenic factors and brought into the presence of one or more angiostatic conditions.

Another control condition in which the endothelial cells are stimulated by one or more angiostatic factors.

By means of these four conditions, it is possible to obtain mRNA preparations specific of angiogenesis, i.e., of the angiogenic state and/or the inhibition of angiogenesis, and to make it possible to detect genes coding for the cellular constituents implicated in the regulation of angiogenesis, including positive regulators and negative regulators. Thus, the method described above enables the systematic screening of all of the angiogenic and angiostatic factors, as well as the different components of the extracellular matrix, for the purpose of revealing and identifying the genes coding for the cellular constituents implicated in the regulation of angiogenesis. Moreover, given that the gene expression can be analyzed all along the pathway of the formation of neovessels by endothelial cells, this approach constitutes an in vitro methodology making it possible to link the gene expression with the biological functional parameters of angiogenesis.

The identification of the fifty-four genes presented below was implemented by means of the methodology described above, using the angiogenic and angiostatic factors, as well as type I collagen as component of the extracellular matrix for reproducing the four experimental conditions.

The fifty-four new genes identified by the sequences SEQ ID No. 1 to SEQ ID No.: 53 and SEQ ID No. 225 in the attached sequence listing are implicated in the regulation mechanism of angiogenesis.

The invention also provides a pharmaceutical composition active for inhibiting angiogenesis, comprising a pharmaceutically acceptable carrier and, as active agent, at least one substance selected from among: (i) a nucleic acid molecule of a gene of an endothelial cell, the expression of which is induced by an angiogenic factor and inhibited by an angiostatic agent, or a complementary sequence or a fragment or derivative thereof; (ii) a polypeptide sequence coded by said nucleic acid molecule or fragment or complement thereof; (iii) a molecule capable of inhibiting the expression of a nucleic acid molecule according to (i) or which binds to a polypeptide sequence according to (ii). Pharmaceutical compositions of the invention can be for human or veterinary use, and are preferably sterile and pyrogen free. Pharmaceutical compositions of the invention comprise, in addition to at least one active ingredient, at least one pharmaceutically acceptable carrier. Suitable pharmaceutically acceptable carriers include water (e.g., sterile water for injection); saline solutions such as physiological saline or phosphate buffered saline (PBS); polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose; stabilizing or preservative agents, such as sodium bisulfite, sodium sulfite and ascorbic acid, citric acid and its salts, ethylenediaminetetraacetic acid, benzalkonium chloride, methyl- or propylparaben chlorobutanol; and combinations thereof.

According to one embodiment, the pharmaceutical composition of the invention comprises as an active ingredient at least one nucleotide sequence selected from the set of nucleotide sequences identified as numbers SEQ ID No. 1 to SEQ ID No. 53, SEQ ID No. 225 and SEQ ID No. 284 to SEQ ID No. 290 in the attached sequence listing, their complementary sequences and their corresponding antisense sequences, or one of their fragments or derivatives.

In the context of the present invention the following should be considered to be equivalent sequences (also called "derivative sequences" or "derivatives"): nucleotide sequences presenting minor structural modifications not changing their function, such as deletions, mutations or additions of bases, the identity of which is at least 90% with the nucleotide sequences identified under the numbers SEQ ID No.: 1 to SEQ ID No. 53, SEQ ID No. 225 and SEQ ID No. 284 to SEQ ID No. 290 in the attached sequence listing. One skilled in the art can readily identify derivatives of the present nucleic acids by testing them for the ability to regulate angiogenesis in the human endothelial cell culture assays described in the "Examples" section below. As used herein, "fragments" of the present nucleic acids comprise a smaller, contiguous sequence of nucleotides found within a larger nucleic acid sequence.

According to another embodiment, the angiogenesis regulatory pharmaceutical composition comprises at least one angiogenesis inhibitory sequence.

According to one embodiment, the angiogenesis regulatory pharmaceutical composition comprises at least one angiogenesis stimulatory sequence.

According to one embodiment, the pharmaceutical composition of the invention comprises one or more angiogenesis inhibitory sequences comprising an antisense sequence comprising all or part of at least one sequence selected from among SEQ ID No. 1 to SEQ ID No. 5, SEQ ID No. 7, SEQ ID No. 9, SEQ ID No. 11 to SEQ ID No. 15, SEQ ID No. 17 to SEQ ID No. 53, SEQ ID No. 225 and SEQ ID No. 284 to SEQ ID No. 290 in the attached listing of sequences.

The pharmaceutical composition of the invention preferably comprises one or more antisense sequences selected from among SEQ ID No. 103 to SEQ ID No. 107, SEQ ID No. 109, SEQ ID No. 111 and SEQ ID No. 113 to SEQ ID No. 148 in the attached sequence listing.

According to a second embodiment, the pharmaceutical composition of the invention comprises one or more stimulatory sequences of angiogenesis, comprising an antisense sequence of at least one of the sequences SEQ ID No. 6, SEQ ID No. 8, SEQ ID No. 10 and SEQ ID No. 16 in the attached sequence listing.

The pharmaceutical composition of the invention preferably comprises antisense sequences selected from among sequences SEQ ID No. 108, SEQ ID No. 110 and SEQ ID No. 112 in the attached sequence listing.

The invention also provides a pharmaceutical composition intended for the diagnosis and/or treatment of pathologies linked to angiogenesis, characterized in that the pharmaceutical composition contains at least one polypeptide sequence selected from among the polypeptide sequences identified by the numbers SEQ ID No. 54 to SEQ ID No. 102 or among the polypeptide sequences identified by the numbers SEQ ID No. 291 to SEQ ID No. 297 in the attached sequence listing.

In the context of the present invention, equivalent sequences (also called "derivative sequences" or "derivatives") should be considered to be those polypeptide sequences presenting minor structural modifications not changing their function, such as deletions, mutations or additions of amino acid residues, the identity of which is at least 85%, preferably at least 90%, with the polypeptide sequences identified by the numbers SEQ ID No. 54 to SEQ ID No. 102 or with the polypeptide sequences identified by the numbers SEQ ID No. 291 to SEQ ID No. 297 in the attached sequence listing. One skilled in the art can readily identify derivatives of the present polypeptides by testing them for the ability to regulate angiogenesis in the human endothelial cell culture assays described in the "Examples" section below. As used herein, "fragments" of the present polypeptides comprise a smaller, contiguous sequence of amino acids found within a larger polypeptide sequence.

The invention also provides a pharmaceutical composition intended for the diagnosis and/or treatment of pathologies linked to angiogenesis, comprising at least one antagonist of one or more of the above-mentioned polypeptide sequences, and a pharmaceutically acceptable carrier.

As used herein, the term "antagonist" is understood to mean any compound which inhibits the biological activity of the polypeptide sequences of the invention in the mechanism of angiogenesis.

For example, a suitable antagonist can comprise an antibody having an affinity for a polypeptide sequence of the invention.

The invention also provides antibodies having an affinity for each of the polypeptide sequences identified by the numbers SEQ ID No. 54 to SEQ ID No. 102, or for the polypeptide sequences identified by the numbers SEQ ID No. 291 to SEQ ID No. 297 in the attached sequence listing, as well as the therapeutic compositions containing such antibodies.

Antibodies of the invention can be obtained by any in vivo or in vitro immunization method from an animal, notably a vertebrate and preferably a mammal, with any one of the polypeptide sequences identified by the numbers SEQ ID No. 54 to SEQ ID No. 102, or with the polypeptide sequences identified by the numbers SEQ ID No. 291 to SEQ ID No. 297 in the attached sequence listing, or one of their fragments which induce immunogenicity to the protein. Suitable immunization methods that can be used to produce antibodies of the invention are within the skill in the art; see, e.g., Kohler G. and Milstein C., Nature 1975 Aug. 7; 256(5517): 495-497, the entire disclosure of which is herein incorporated by reference.

The antibodies can be polyclonal or monoclonal antibodies.

The invention also provides a therapeutic or diagnostic composition comprising one or more antibodies having an affinity for one or more of the polypeptide sequences identified by the numbers SEQ ID No. 54 to SEQ ID No. 102 or for the polypeptide sequences identified by the numbers SEQ ID No. 291 to SEQ ID No. 297, or for one of their fragments or derivatives, which induce immunogenicity to the protein prepared as indicated above.

Another object of the invention pertains to antisense nucleotide sequences of the nucleotide sequences identified by the numbers SEQ ID No. 1 to SEQ ID No. 53, SEQ ID No. 225 and SEQ ID No. 284 to SEQ ID No. 290 in the attached sequence listing.

In the context of the present invention, the term "antisense sequence" is understood to mean any DNA sequence of at least 10 nucleotides complementary to at least a portion of an mRNA, which inhibits its expression of that mRNA; i.e., its translation into a protein.

For example, the antisense sequences can have an identity of at least about 80%, at least about 85% or at least about 90%, preferably at least about 95%, and more preferably at least about 99%, with a sequence selected from among the sequences identified by numbers SEQ ID No. 103 to SEQ ID No. 148 in the attached sequence listing.

The invention also provides a mammalian expression vector comprising at least one antisense sequence as defined above.

The vector of the invention can be selected from among the group of vectors GS-V1 to GS-V46 carrying the at least one of SEQ ID No. 149 to SEQ ID No. 194 in the attached sequence listing.

The introduction of said sequences SEQ ID No. 103 to SEQ ID No. 148 into mammalian expression vectors and the subsequent insertion of said vectors into mammalian cells produces cell lines underexpressing the genes intervening in the mechanism of angiogenesis.

The invention also provides a mammalian expression vector, said vector comprising at least one antisense sequence of at least one of the sequences identified by the numbers SEQ ID No. 1 to SEQ ID No. 53, SEQ ID No. 225 and SEQ ID No. 284 to SEQ ID No. 290 in the attached sequence listing, as well as a promoter which enables the expression of said antisense DNA.

Specific primers for each of the identified sequences are designed for the construction of these vectors.

These particularly preferred primers are indicated in Table I below and identified by the sequence numbers SEQ ID No. 195 to SEQ ID No. 222, SEQ ID No. 226 to SEQ ID No. 283 and SEQ ID No. 298 to SEQ ID No. 299 in the attached sequence listing.

Amplification of the bacterial plasmid comprising the cloned gene is advantageously effected by means of primers hybridizing with the regions of the plasmid surrounding the cloned gene. The primers also comprise on their ends certain restriction sites not contained in the cloned fragment or present in the multisite region of the expression vector.

For example, in the context of the cloned fragments employed in the present invention, the restriction sites employed with the expression vector pCI are the sites SalI and MluI. These two restriction sites can be interchanged depending on whether the fragment was cloned in the bacterial plasmid in its sense or antisense orientation.

As an example, the primers GS-PGS-F (SEQ ID No. 223) and GS-PGM-R (SEQ ID No. 224) are used for fragments cloned in the sense orientation in the bacterial plasmid (GS-N15).

These particular primers can be used in a universal manner for transferring all of the fragments cloned in sense orientation in a bacterial vector for integrating the expression vector in the antisense orientation.

The primers GS-PGM-F (SEQ ID No. 300) and GS-PGS-R (SEQ ID No. 301) are used for fragments cloned in antisense orientation in the bacterial plasmid (GS-N46).

These particular primers can be used in a universal manner for transferring all of the fragments cloned in antisense orientation in a bacterial vector for integrating the expression vector in the antisense orientation.

The invention also provides a mammalian expression vector comprising at least one nucleotide sequence selected from among the set of sequences identified by the numbers SEQ ID No. 1 to SEQ ID No. 53, SEQ ID No. 225 and SEQ ID No. 284 to SEQ ID No. 290 in the attached sequence listing, or one of their fragments or derivatives.

These vectors are useful for preparing pharmaceutical compositions intended for the treatment of angiogenic disorders, for verifying the efficacy of a treatment of an angiogenic disorder in a mammal, notably a human being, or for verifying the functionality of genes possibly implicated in the mechanism of angiogenesis in a mammal.

The invention therefore also provides a genetically modified cell comprising at least one of the vectors comprising the antisense sequences for inhibiting expression of at least one nucleotide sequence selected from among the sequences SEQ ID No. 1 to SEQ ID No. 53, SEQ ID No. 225 and SEQ ID No. 284 to SEQ ID No. 290 in the attached sequence listing.

The invention also provides a method for the preparation of a genetically modified cell line expressing a nucleotide sequence in a stable manner, said vector comprising at least one antisense sequence of at least one of the sequences identified by the numbers SEQ ID No. 1 to SEQ ID No. 53, SEQ ID No. 225 and SEQ ID No. 284 to SEQ ID No. 290 in the attached sequence listing, as well as a promoter which enables the expression of said antisense DNA. The method comprises the following steps:

a) introducing a gene of resistance to at least one antibiotic into said genetically modified cell;

b) culturing the cells obtained in step (a) in the presence of said antibiotic; and c) selecting the viable cells.

The invention also provides a pharmaceutical composition intended for the diagnosis and/or treatment of pathologies linked to angiogenesis comprising as active principle said genetically modified cell.

The invention also provides a genetically modified cell comprising at least one vector comprising a nucleotide sequence selected from among the set of sequences identified by the numbers SEQ ID No. 1 to SEQ ID No. 53, SEQ ID No. 225 and SEQ ID No. 284 to SEQ ID No. 290 in the attached sequence listing, or one of their fragments or derivatives.

The invention thus pertains to a method for the preparation of a line of genetically modified cells expressing a nucleotide sequence in a stable manner, said vector comprising at least one of the sequences identified by the numbers SEQ ID No. 1 to SEQ ID No. 53, SEQ ID No. 225 and SEQ ID No. 284 to SEQ ID No. 290 in the attached sequence listing, or one of their fragments or derivatives, as well as a promoter enabling the expression of said antisense DNA. The method comprises the following steps:

a) introducing a gene of resistance to at least one antibiotic into said genetically modified cell;

b) culturing the cells obtained in step (a) in the presence of said antibiotic; and c) selecting the viable cells.

It is thus possible to isolate human cells and transfecting them in vitro with at least one of the vectors defined above, which vectors code for at least one of the genes whose sequences are identified by the numbers SEQ ID No. 1 to SEQ ID No. 53, SEQ ID No. 225 and SEQ ID No. 284 to SEQ ID No. 290, or one of their fragments or derivatives. These genetically modified cells can then be administered to a mammal, preferably a human being.

Therapeutic compositions containing such cells can be presented in the form of simple cellular suspensions, but can also be encapsulated in a suitable device using, e.g., semipermeable membranes.

Another object of the invention is a method for the preparation of a protein coded by at least one of the nucleic acids whose sequences are identified by the numbers SEQ ID No. 1 to SEQ ID No. 53, SEQ ID No. 225 and SEQ ID No. 284 to SEQ ID No. 290 in the attached sequence listing, or one of their fragments or derivatives.

These proteins, which are identified by the sequences SEQ ID No. 54 to SEQ ID No. 102 and SEQ ID No. 291 to SEQ ID No. 297 in the attached sequence listing, or their fragments or derivatives can be produced in vitro in the form of recombinant proteins by introducing into a suitable host a corresponding suitable expression vector. The proteins, or fragments or derivatives thereof, thus produced are then purified and subsequently used as a therapeutic agent.

A method for preparing a recombinant protein comprises the steps of:

a) constructing an expression vector comprising at least one sequence from among those identified by the numbers SEQ ID No. 1 to SEQ ID No. 53, SEQ ID No. 225 and SEQ ID No. 284 to SEQ ID No. 290 in the attached sequence listing, or one of their fragments or derivatives;

b) introducing said vector into a cellular host;

c) culturing said cells in a suitable medium; and d) purifying the expressed proteins or one of their fragments or derivatives.

The invention also provides a recombinant protein obtained by the above-described method.

As an example, systems for expressing recombinant proteins in bacteria such as *E. coli* can be used for expressing proteins (including non-glycosylated proteins).

The entire or partial sequence of the nucleic acid of interest can be amplified by PCR using specific primers, which preferably contain different restriction enzyme digestion sites at the ends so as to enable orientation of the gene in the expression vector. The amplified DNA is purified, then digested by the appropriate restriction enzymes. The digested nucleic acid is then inserted by standard ligation techniques in the expression vector previously digested by these same restriction enzymes. Any suitable vector can be used, such as the vector pBR322 (Bolivar et al., Gene 2 (1977) 95-113) or its derivatives containing the RNA polymerase promoter of the bacteriophage T7 for a high level of expression. Such pBR322 derivatives include the plasmid pET3a (Studier and Moffatt, 1986, J. Mol. Biol., 189(1): 113-30).

Preferably, vectors used in accordance with the present invention contain sequences that code for selection markers (resistance to antibiotics), a multiple cloning site containing the sites of restriction enzymes suitable for the insertion of DNA, and the cell/host system is preferably an inducible system such as that used for the in vivo radiotagging of the growth factor FGF2 (Colin et al., 1997, Eur. J. Biochem., 249, 473-480) and already described by Patry et al. (1994, FEBS Lett., 349(1): 23-8), the disclosures of which are herein incorporated by reference. Suitable vectors can also contain a region coding for a polyhistidine tail at the end of the protein of interest in order to facilitate purification of encoded proteins.

In the practice of the present methods, the amplified DNA is ligated in the plasmid which is transformed in the bacterium according to any suitable method, such as the method described by Sambrook et al. (1989, Molecular Cloning: A Laboratory Manual, $2^{nd}$ ed., Cold Spring Harbor Laboratory Press, Cold Spring Harbor, N.Y.). The transformed cells can then be spread on agar LB medium containing antibiotics. Colonies resistant to the antibiotics, which are formed by bacteria carrying the recombinant plasmid, are isolated. The plasmid DNA can then be isolated from the bacteria and sequenced to confirm the construction of the vector. The production and purification of the recombinant protein from the isolated vectors can be performed as described ((Patry et al., 1994, FEBS Lett., 349(1): 23-8), 473-480, the entire disclosure of which is herein incorporated by reference).

For example, an isolated colony is inoculated in the liquid culture medium such as the LB broth medium with the addition of antibiotics. After overnight incubation, the preculture can be used for seeding a culture of a larger volume. The expression of the polypeptide is then induced, the cells develop over several hours and are then collected by centrifugation. The cellular deposit can be lysed by chemical agents known in the art, or mechanically, e.g., by sonication. The protein can be purified by means of its physicochemical properties as described for the purification of recombinant FGF2 (Colin et al., 1997, Eur. J. Biochem., 249, 473-480, the entire disclosure of which is herein incorporated by reference). If the protein is labeled with a polyhistidine tail, it can be purified via this tail by immobilization on a chelating agent support of metallic ions, as described (Tang et al., Protein Expr. Purif. 1997 December; 11(3): 279-83, the entire disclosure of which is herein incorporated by reference).

As a further example, expression vectors for expressing proteins having post-translational modifications such as glycosylation, such as the eukaryote systems (yeasts, plants, insects), can be used.

Thus, the recombinant protein can be produced, e.g., in the yeast *Pichia pastoris* as described by Sreekrishna et al. (1988, J. Basic Microbiol., 28(4): 265-78, the entire disclosure of which is herein incorporated by reference). The amplified DNA can be introduced in the same manner after digestion and ligation in an expression vector of *Pichia pastoris*, preferably containing a sequence coding for a selection marker. A suitable *Pichia pastoris* vector is described in Scorer et al., biotechnology (NY), 1994 February; 12(2): 181-4, the entire disclosure of which is herein incorporated by reference. The protein can either remain intracellular or can be secreted if the vector contains, at the end of the introduced gene, a sequence coding for a signal sequence of secretion such as, e.g., the prepropeptide factor of *Saccharomyces cerevisiae* (Cregg et al., 1993; Scorer et al., 1993). A histidine tail can also be added to one of the ends of the recombinant protein in order to facilitate purification (Mozley et al., 1997, Photochem. Photobiol. 665(5): 710-5).

Said host is preferably selected from among: a bacterium, a yeast, an insect cell, a mammal cell, or a plant cell.

The administration of therapeutic compositions comprising such proteins can be implemented, e.g., via the topical, oral, intradermal, transdermal intra-ocular or intravenous route, or any other suitable enteral or parenteral route.

The fragments of said proteins can be used as antagonists of the protein from which they originate. Thus, the administration to an animal of a therapeutic composition containing such fragments is recognized for inducing a diminution of the activity of said protein in the angiogenesis mechanism for a given pathology.

The present invention also provides a method for the diagnosis of an angiogenic pathology in a mammal, notably in a human being, consisting of detecting in the cells of said mammal the overexpression or the underexpression of one or more nucleotide sequences identified by the numbers SEQ ID No. 1 to SEQ ID No. 53, SEQ ID No. 225 and SEQ ID No. 284 to SEQ ID No. 290 in the attached sequence listing.

Such a diagnostic method comprises the following steps:
detecting the expression of one or more of said nucleotide sequences SEQ ID No. 1 to SEQ ID No. 53, SEQ ID No. 225 and SEQ ID No. 284 to SEQ ID No. 290 in a cell population of a mammal;
detecting the expression of the same nucleotide sequences by a reference cell population whose angiogenic state is known; and
identifying the differences in the level of expression in cells of the same nucleotide sequences by the two cell populations.

The present invention also provides a diagnostic and prognostic method for an angiogenic pathology in a mammal, notably in a human being, consisting of detecting in the cells of said mammal the overexpression or the underexpression of one or more polypeptide sequences identified by the numbers SEQ ID No. 54 to SEQ ID No. 102, or of the polypeptide sequences identified by the numbers SEQ ID No. 291 to SEQ ID No. 297 in the attached sequence listing.

As used herein, a "cell population of a mammal" is a collection of mammalian cells of a certain type or lineage, or which are obtained from the same tissue or organ. It is understood that a cell population of a mammal can comprise different cell types; for example, when the population is obtained from the same tissue (e.g., blood) or organ (e.g., the liver). A cell population of a mammal can be obtained from both in vivo and in vitro (i.e., cultured cell) sources.

As used herein, a "reference cell population" is a collection of cells of a certain type or lineage, or which are obtained from the same tissue or organ, for which the angiogenic state is known. It is understood that a "reference cell population" can comprise different cell types, and can be obtained from both in vivo and in vitro sources.

As used herein, a gene is "overexpressed" when that gene produces an amount of RNA and/or corresponding protein in a cell population of a mammal which is greater than the amount of RNA and/or corresponding protein produced from the same gene in a reference cell population.

As used herein, a gene is "underexpressed" when that gene produces an amount of RNA and/or corresponding protein in a cell population of a mammal which is less than the amount of RNA and/or corresponding protein produced from the same gene in a reference cell population.

According to a preferred embodiment, said method comprises the following steps:
a) detecting one or more of polypeptide sequences SEQ ID No. 54 to SEQ ID No. 102, or polypeptide sequences identified by the numbers SEQ ID No. 291 to SEQ ID No. 297, in a cell population obtained from a mammal.

b) detecting the expression of these same polypeptide sequences in a reference cell population whose angiogenic state is known; and c) identifying the differences in the level of expression of these same polypeptide sequences in the two cell populations.

According to one particular embodiment, in the diagnostic method of the invention, the detection of the expression of the polypeptide sequences is performed after the endothelial cells have been contacted with a biological fluid originating from a patient.

The present invention also provides a method for the verification of the therapeutic efficacy of an angiogenic treatment in a mammal, notably in a human being, by the identification of a cell population in said mammal capable of overexpressing or underexpressing one or more nucleotide sequences identified by the numbers SEQ ID No. 1 to SEQ ID No. 53, SEQ ID No. 225 and SEQ ID No. 284 to SEQ ID No. 290 in the attached sequence listing.

Such a method for the verification of therapeutic efficacy comprises the following steps:

detecting the expression of one or more of nucleotide sequences SEQ ID No. 1 to SEQ ID No. 53 and SEQ ID No. 225 in a cell population from a mammal, to which is administered a therapeutic composition intended to treat an angiogenic disorder;

detecting the expression of these same nucleotide sequences by a reference cell population whose angiogenic state is known; and identifying the differences in the level of expression of these same nucleotide sequences in the two cell populations.

According to preferred modes of implementation, the verification method is performed on a cell population from a mammal in vivo, ex-vivo or on a cell population isolated from said mammal in vitro.

According to one particular embodiment, in the verification method of the invention, the detection of the expression of the sequences is performed after having contacted the endothelial cells with a biological fluid obtained from a patient.

The present invention also pertains to a method for screening for compounds useful for treating an angiogenic pathology of a mammal, notably a human being.

According to one preferred mode of implementation, such a screening method comprises the following steps:

detecting the expression of one more of nucleotide sequences SEQ ID No. 1 to SEQ ID No. 53, SEQ ID No. 225 and SEQ ID No. 284 to SEQ ID No. 290 in a cell population contacted with a compound capable of having a therapeutic effect on an angiogenic pathology;

detecting the expression of these same nucleotide sequences in a reference cell population whose angiogenic state is known; and identifying the differences in the level of expression of these same nucleotide sequences in the two cell populations.

According to another preferred embodiment, such a screening method also comprises the following steps:

detecting the expression of one or more of polypeptide sequences identified by the numbers SEQ ID No. 54 to SEQ ID No. 102, or with the polypeptide sequences identified by the numbers SEQ ID No. 291 to SEQ ID No. 297, in the attached sequence listing by a cell population contacted with a compound capable of having, or which has, a therapeutic effect on an angiogenic pathology;

detecting the expression of these same polypeptide sequences in a reference cell population whose angiogenic state is known; and identifying the differences in the level of expression of these same polypeptide sequences in the two cell populations.

As used herein, a compound has a "therapeutic effect" on an angiogenic pathology when, upon administration of that compound to an individual suffering from an angiogenic pathology, the symptoms of the angiogenic pathology are lessened, prevented or otherwise alleviated, or the growth of new blood vessels in the region of the angiogenic pathology is slowed or halted. In the practice of the present method, it is understood that a test compound which causes a difference in the expression of nucleotide sequences between a cell population of a mammal and a reference population indicates that the test compound has a therapeutic effect on an angiogenic pathology.

According to one particular embodiment, in the screening method of the invention the detection of expression of the sequences is performed after contacting the endothelial cells with a biological fluid obtained from a patient.

The following can be cited among the angiogenic pathologies (also called "angiogenic disorders") that could be diagnosed or treated with the methods and pharmaceutical compositions of the invention: tumor vascularization, retinopathies (e.g., diabetic retinopathy), rheumatoid arthritis, Crohn's disease, atherosclerosis, hyperstimulation of the ovary, psoriasis, endometriosis associated with neovascularization, restenosis due to balloon angioplasty, tissue overproduction due to cicatrization, peripheral vascular disease, hypertension, vascular inflammation, Raynaud's disease and phenomena, aneurism, arterial restenosis, thrombophlebitis, lymphangitis, lymphedema, cicatrization and tissue repair, ischemia, angina, myocardial infarction, chronic heart disease, cardiac insufficiencies such as congestive heart failure, age-linked macular degeneration and osteoporosis.

The invention also provides a device comprising a support. The support comprises one or more probes specific of one or more nucleotide sequences identified by the numbers SEQ ID No. 1 to SEQ ID No. 53, SEQ ID No. 225 and SEQ ID No. 284 to SEQ ID No. 290 in the attached sequence listing, or fragments or derivatives thereof, for the implementation of the screening method of the invention.

In the context of the present invention, the term "probe" is understood to mean any single-strand DNA fragment the sequence of which is complementary to a target sequence: this target sequence thus can be detected by hybridization with the labeled probe (labeled by incorporation of, e.g., radioactive atoms or fluorescent groups), which play the role of a molecular "fish hook".

According to preferred embodiments, the support of a device of the invention is selected from among a glass membrane, a metal membrane, a polymer membrane or a silica membrane.

Devices of the invention can be, e.g., DNA chips comprising one or more nucleotide sequences identified by the numbers SEQ ID No. 1 to SEQ ID No. 53, SEQ ID No. 225 and SEQ ID No. 284 to SEQ ID No. 290 in the attached sequence listing.

The invention also provides a kit intended for measuring the differential display of genes implicated in angiogenic pathologies, comprising a device as described above, specific primers and the accessories required for the amplification of the sequences extracted from a sample, hybridization with the probes of the device and the performance of the differential display measurements.

The invention also provides a kit intended for the measurement of the differential display of genes implicated in angiogenic disorders, comprising as a reference a cell population genetically modified cell line expressing, in a stable manner, a vector comprising at least one of the nucleotide sequences identified by the numbers SEQ ID No. 1 to SEQ ID No. 53, SEQ ID No. 225 and SEQ ID No. 284 to SEQ ID No. 290 in the attached sequence listing, or one of their fragments or derivatives, and the means required for measuring said differential display.

The invention also provides a kit intended for the measurement of the differential display of genes implicated in angiogenic disorders, comprising as a reference cell population a genetically modified cell line expressing in a stable manner the vector expressing at least one antisense sequence of the nucleotide sequences identified by the numbers SEQ ID No. 1 to SEQ ID No. 53, SEQ ID No. 225 and SEQ ID No. 284 to SEQ ID No. 290 in the attached sequence listing, or one of their fragments or derivatives, and the means required for the measurement of said differential display.

Verification that the fifty-four genes identified by the present invention are implicated in the mechanism of angiogenesis was performed according to the methodology described in the Material and Methods section below, and is illustrated by means of attached FIGS. 1 to 11 in which:

FIG. 1 shows that the expression of GS-V1, GS-V2, GS-V4, GS-V5 and GS-V15 in human endothelial cells inhibits the formation of capillary tubes. This Figure shows endothelial cells transfected with: 1A) GS-V1 coding for the specific antisense transcript of GS-N1; 1B) GS-V2 coding for the specific antisense transcript of GS-N2; 1C) GS-V4 coding for the specific antisense transcript of GS-N4; 1D) GS-V5 coding for the specific antisense transcript of GS-N5; 1E) GS-V15 coding for the specific antisense transcript of GS-N15; and 1F) the empty vector (control).

Figure 2:
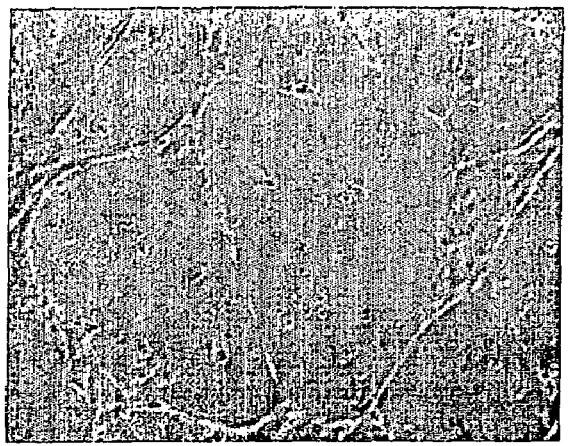
FIG. 2 is a photomicrograph of a human endothelial cell culture showing capillary tube formation upon transfection of cells with expression vectors 2A) GS-V3; 2B) GS-V14; and 2C) empty (control) vector.
Figure 2:
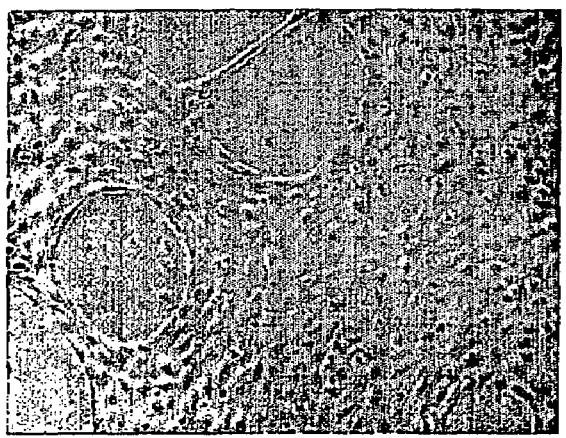
Figure 2:

FIG. 2 shows that the expression of GS-V3 and GS-V14 in human endothelial cells inhibits the formation of capillary tubes. This Figure shows endothelial cells transfected with: 2A) GS-V3 coding for the specific antisense transcript of GS-N3; 2B) GS-V13 coding for the specific antisense transcript of GS-N13; and 2C) the empty vector (control).

Figure 3:
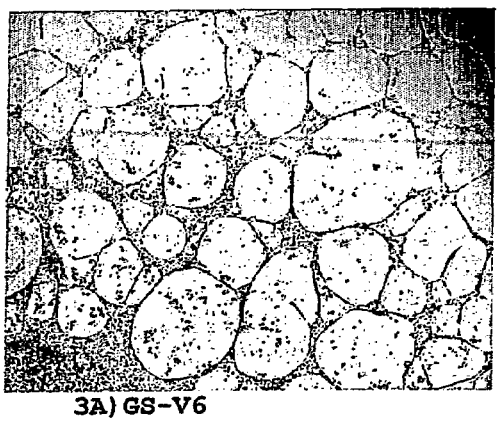
FIG. 3 is a photomicrograph of a human endothelial cell culture showing capillary tube formation upon transfection of cells with expression vectors 3A) GS-V6; 3B) GS-V8; 3C) GS-V10; and 3D) empty (control) vector.
Figure 3:
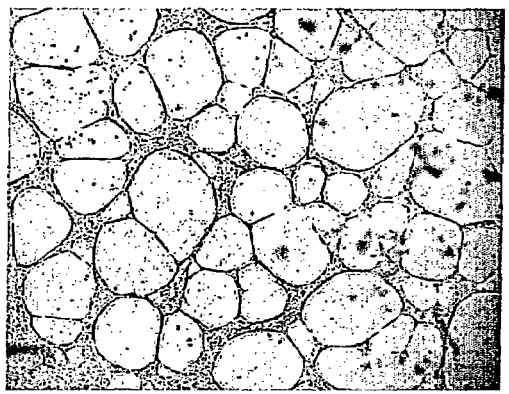
Figure 3:
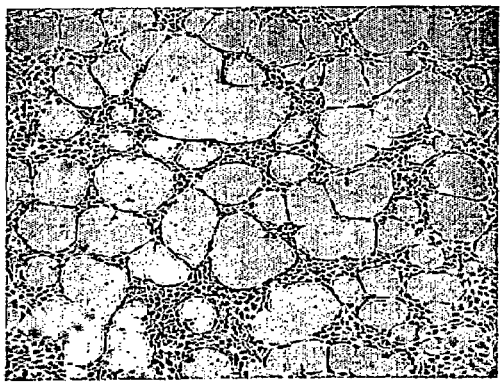
Figure 3:
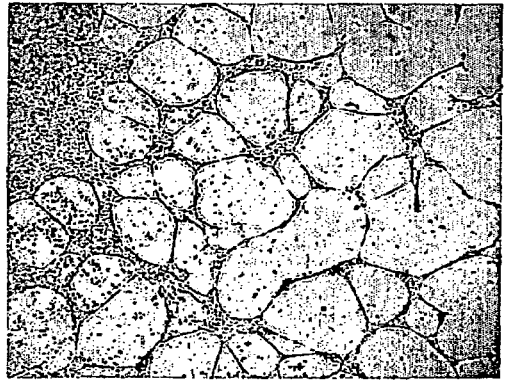

FIG. 3 shows that the expression of GS-V6, GS-V8 and GS-V10 in human endothelial cells induces the formation of capillary tubes. This Figure shows transfected endothelial cells in which: 3A) GS-V6 coding for the specific antisense transcript of GS-N6; 3B) GS-V8 coding for the specific antisense transcript of GS-N8; 3C) GS-V10 coding for the specific antisense transcript of GS-N10 and its homologue GS-N54; and 3D) the empty vector (control).

Figure 4:
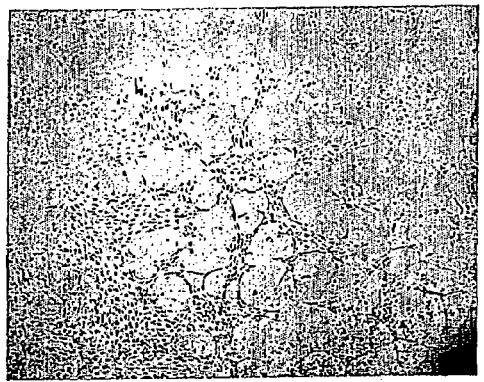
FIG. 4 is a photomicrograph of a human endothelial cell culture showing capillary tube formation upon transfection of cells with expression vectors 4A) GS-V7; 4B) GS-V9; 4C) GS-V12; 4D) GS-V12; 4E) GS-V14 and 4F) empty (control) vector.
Figure 4:
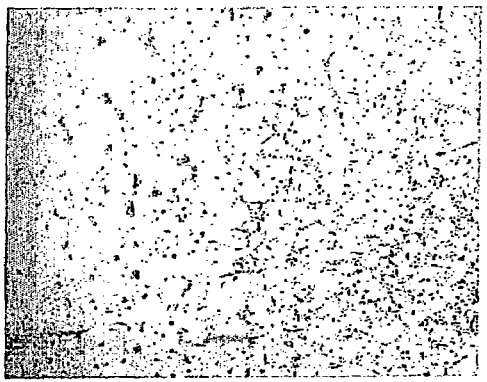
Figure 4:
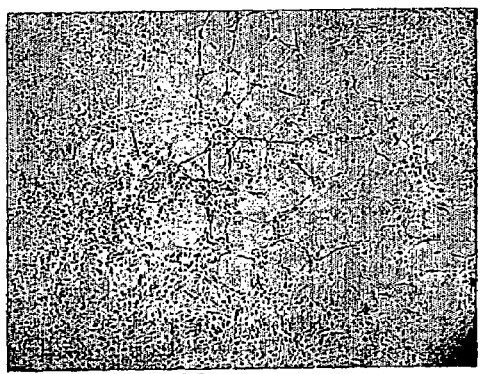
Figure 4:
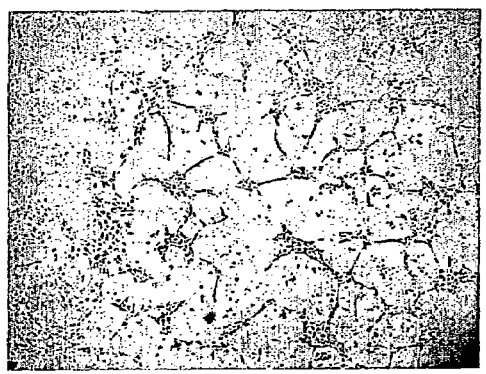
Figure 4:
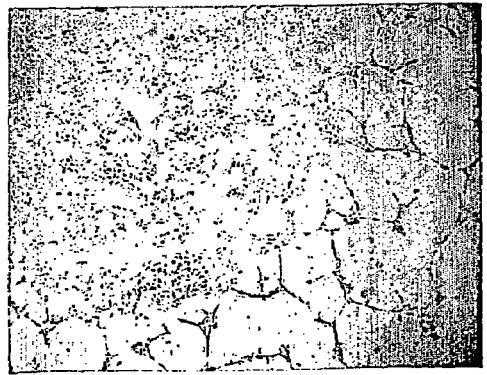
Figure 4:
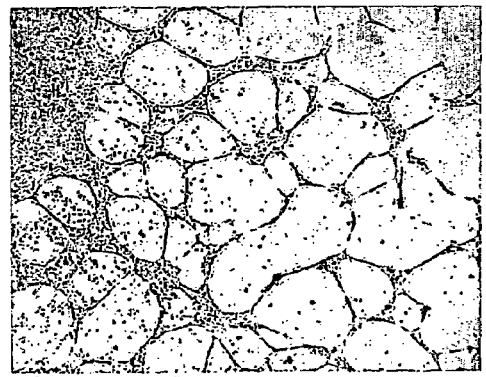

FIG. 4 shows that the expression of GS-V7, GS-V9, GS-V11, GS-V12 and GS-V14 in human endothelial cells inhibits the formation of capillary tubes. This Figure shows endothelial cells transfected with: 4A) GS-V7 coding for the specific antisense transcript of GS-N7; 4B) GS-V9 coding for the specific antisense transcript of GS-N9; 4C) GS-V11 coding for the specific antisense transcript of GS-N11; 4D) GS-V12 coding for the specific antisense transcript of GS-N12; and 4E) GS-V14 coding for the specific antisense transcript of GS-N14 and 4F) the empty vector (control).

Figure 5:
FIG. 5 is a photomicrograph of a human endothelial cell culture showing capillary tube formation upon transfection of cells with expression vectors 5A) GS-V16; 5B) GS-V17; 5C) GS-V18; 5D) GS-V19; 5E) GS-V21 and 5F) empty (control) vector.
Figure 5:
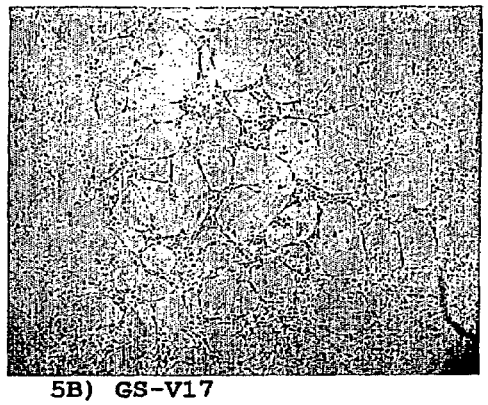
Figure 5:
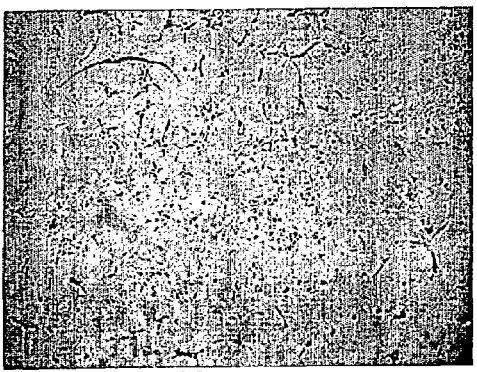
Figure 5:
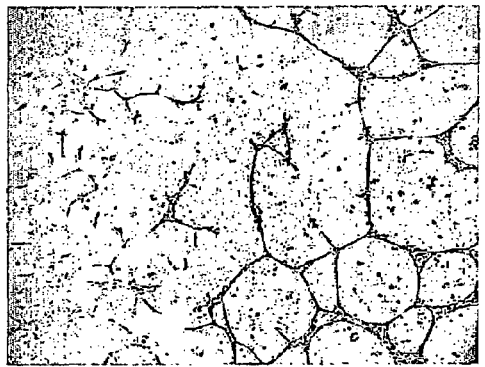
Figure 5:
Figure 5:
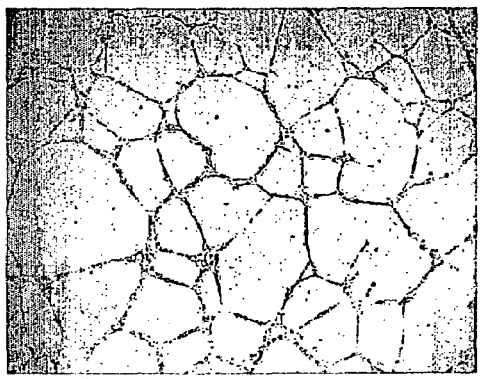

FIG. 5 shows that the expression of GS-V16, GS-V17, GS-V18, GS-V19 and GS-V21 in human endothelial cells inhibits the formation of capillary tubes. This Figure shows endothelial cells transfected with: 5A) GS-V16 coding for the specific antisense transcript of GS-N16; 5B) GS-V17 coding for the specific antisense transcript of GS-N17; 5C) GS-V18 coding for the specific antisense transcript of GS-N18; 5D) GS-V19 coding for the specific antisense transcript of GS-N19; 5E) GS-V21 coding for the specific antisense transcript of GS-N21; and 5F) the empty vector (control).

Figure 6:
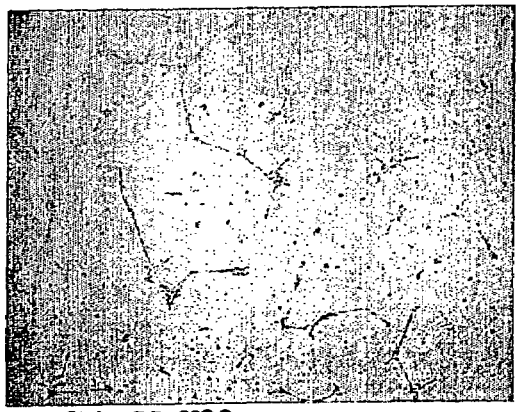
FIG. 6 is a photomicrograph of a human endothelial cell culture showing capillary tube formation upon transfection of cells with expression vectors 6A) GS-V22; 6B) GS-V24; 6C) GS-V25; 6D) GS-V26; 6E) GS-V27; and 6F) empty (control) vector.
Figure 6:
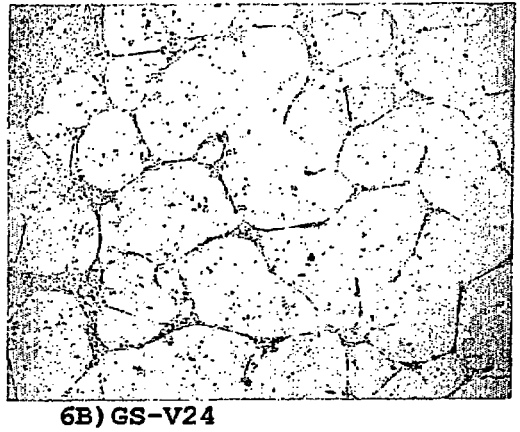
Figure 6:
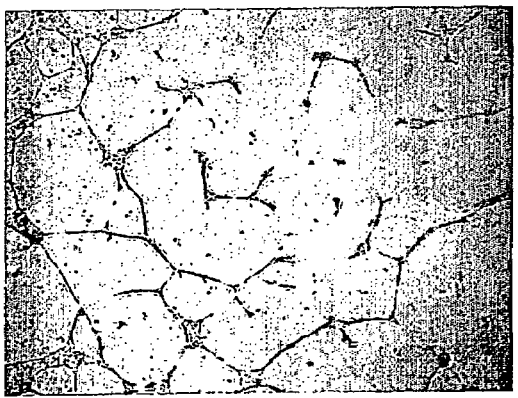
Figure 6:
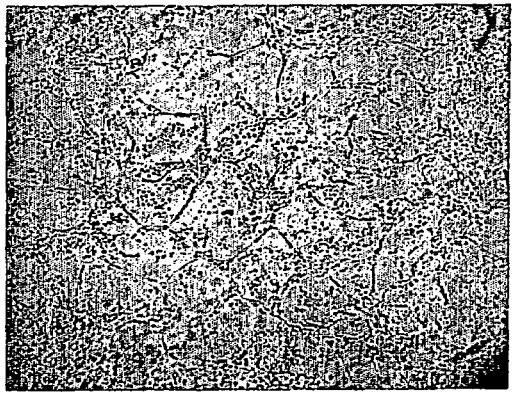
Figure 6:
Figure 6:
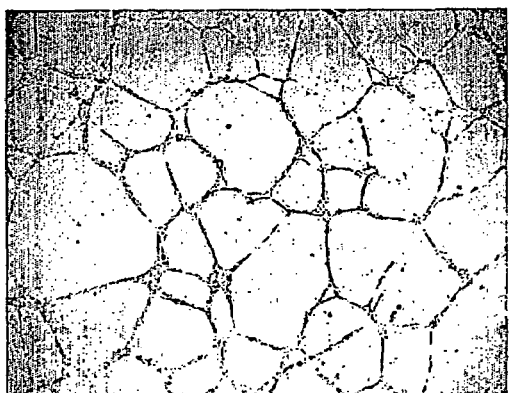

FIG. 6 shows that the expression of GS-V22, GS-V24, GS-V25, GS-V26 and GS-V27 in human endothelial cells inhibits the formation of capillary tubes. This Figure shows endothelial cells transfected with: 6A) GS-V22 coding for the specific antisense transcript of GS-N22; 6B) GS-V24 coding for the specific antisense transcript of GS-N24 and of its homologue GS-N49; 6C) GS-V25 coding for the specific antisense transcript of GS-N25 and of its homologue GS-N50; 6D) GS-V26 coding for the specific antisense transcript of GS-N26; 6E) GS-V27 coding for the specific antisense transcript of GS-N27 and of its homologue GS-N51; and 6F) the empty vector (control).

Figure 7:
FIG. 7 is a photomicrograph of a human endothelial cell culture showing capillary tube formation upon transfection of cells with expression vectors 7A) GS-V28; 7B) GS-V29; 7C) GS-V30; 7D) GS-V31; 7E) GS-V32; and 7F) empty (control) vector.
Figure 7:
Figure 7:
Figure 7:
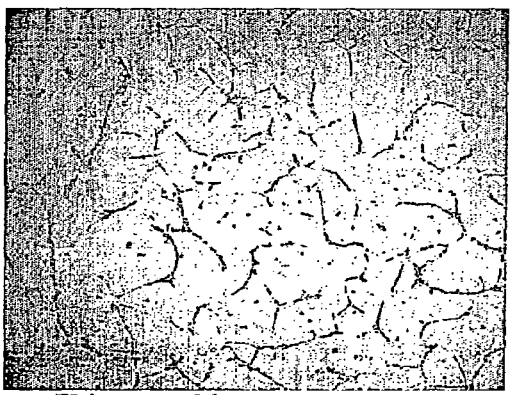
Figure 7:
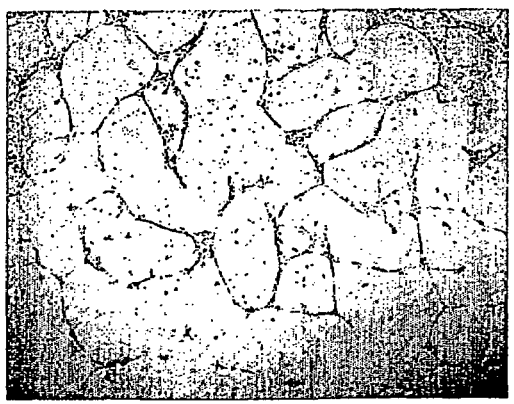
Figure 7:
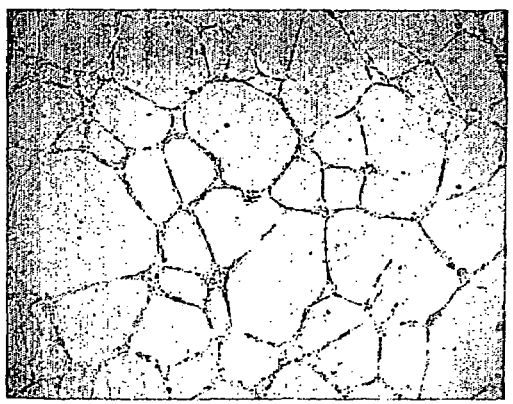

FIG. 7 shows that the expression of GS-V28, GS-V29, GS-V30, GS-V31 and GS-V32 in human endothelial cells inhibits the formation of capillary tubes. This Figure shows endothelial cells transfected with: 7A) GS-V28 coding for the specific antisense transcript of GS-N28; 7B) GS-V29 coding for the specific antisense transcript of GS-N29 and of its homologue GS-N52; 7C) GS-V30 coding for the specific antisense transcript of GS-N30; 7D) GS-V31 coding for the specific antisense transcript of GS-N31 and of its homologue GS-N53; 7E) GS-V32 coding for the specific antisense transcript of GS-N32; and 7F) the empty vector (control).

Figure 8:
FIG. 8 is a photomicrograph of a human endothelial cell culture showing capillary tube formation upon transfection of cells with expression vectors 8A) GS-V33; 8B) GS-V34; 8C) GS-V35; 8D) GS-V37; 8E) GS-V38; and 8F) empty (control) vector.
Figure 8:
Figure 8:
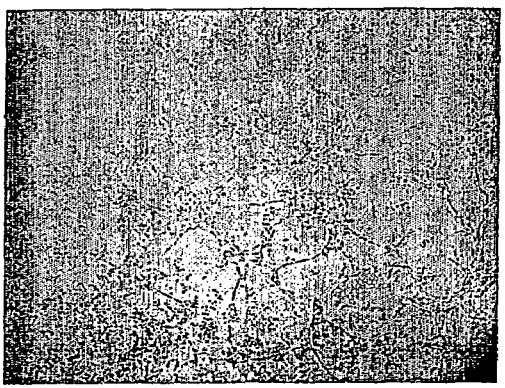
Figure 8:
Figure 8:
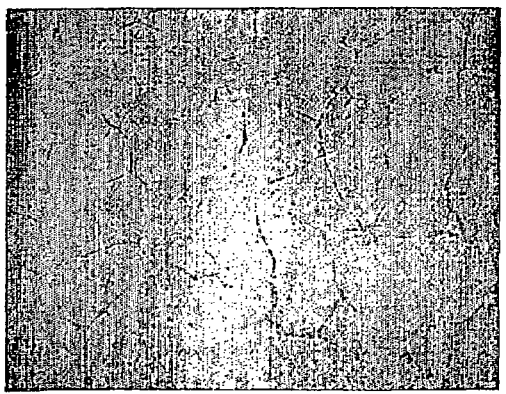
Figure 8:
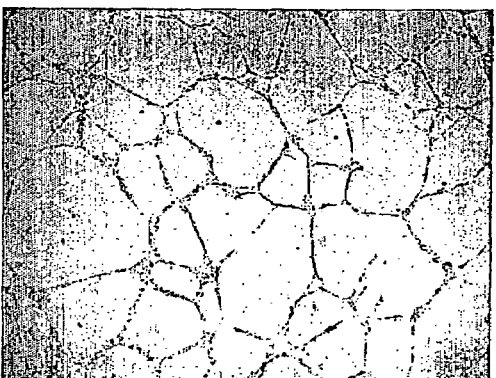

FIG. 8 shows that the expression of GS-V33, GS-V34, GS-V35, GS-V37 and GS-V38 in human endothelial cells inhibits the formation of capillary tubes. This Figure shows endothelial cells transfected with: 8A) GS-V33 coding for the specific antisense transcript of GS-N33; 8B) GS-V34 coding for the specific antisense transcript of GS-N34; 8C) GS-V35 coding for the specific antisense transcript of GS-N35; 8D) GS-V37 coding for the specific antisense transcript of GS-N37; 8E) GS-V38 coding for the specific antisense transcript of GS-N38; and 8F) the empty vector (control).

Figure 9:
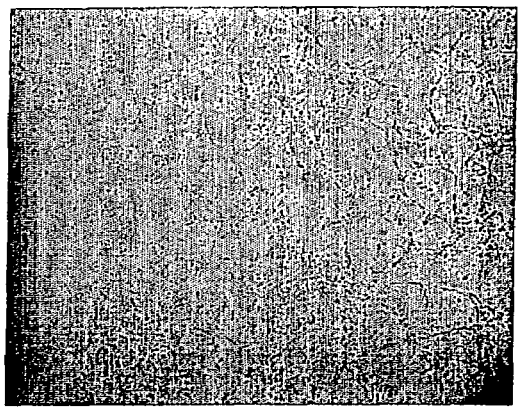
FIG. 9 is a photomicrograph of a human endothelial cell culture showing capillary tube formation upon transfection of cells with expression vectors 9A) GS-V40; 9B) GS-V42; 9C) GS-V43; 9D) GS-V44; 9E) GS-V45; and 9F) empty (control) vector.
Figure 9:
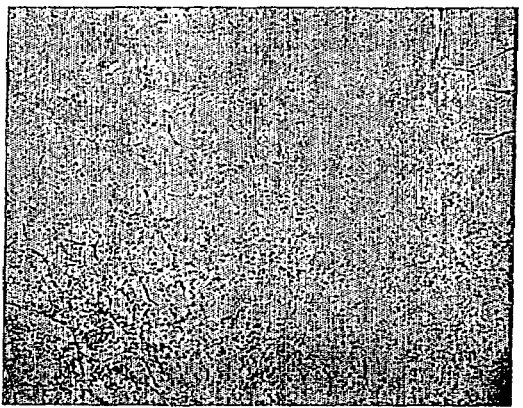
Figure 9:
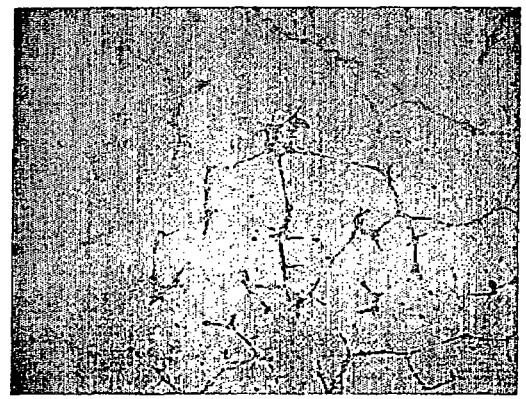
Figure 9:
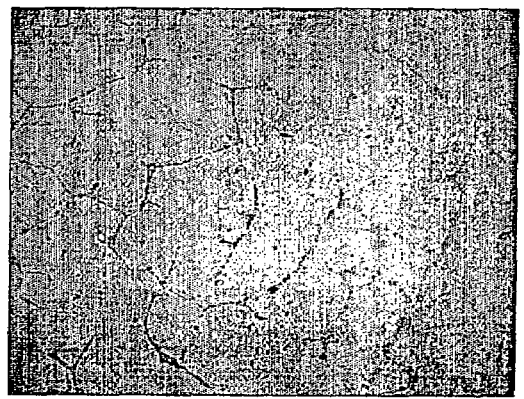
Figure 9:
Figure 9:
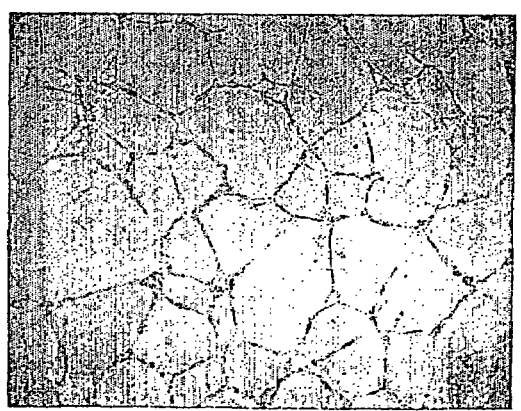

FIG. 9 shows that the expression of GS-V40, GS-V42, GS-V43, GS-44 and GS-V45 in human endothelial cells inhibits the formation of capillary tubes. This Figure shows endothelial cells transfected with: 9A) GS-V40 coding for the specific antisense transcript of GS-N40; 9B) GS-V42 coding for the specific antisense transcript of GS-N42; 9C) GS-V43 coding for the specific antisense transcript of GS-N43; 9D) GS-V44 coding for the specific antisense transcript of GS-N44; 9E GS-V45 coding for the specific antisense transcript of GS-N45; and 9F) the empty vector (control).

Figure 10:
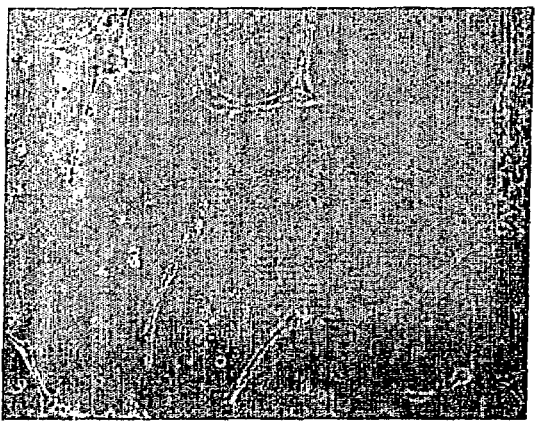
FIG. 10 is a photomicrograph of a human endothelial cell culture showing capillary tube formation upon transfection of cells with expression vectors 10A) GS-V20; 10B) GS-V23; 10C) GS-V36; 10D) GS-V39; 10E) GS-V41; and 10F) empty (control) vector.
Figure 10:
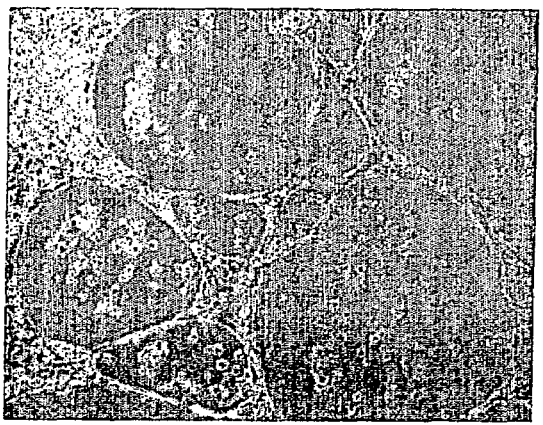
Figure 10:
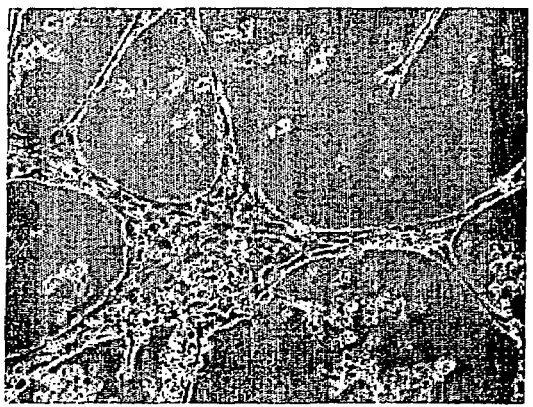
Figure 10:
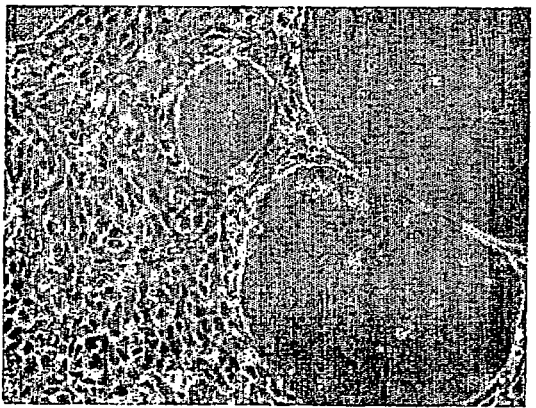
Figure 10:
Figure 10:
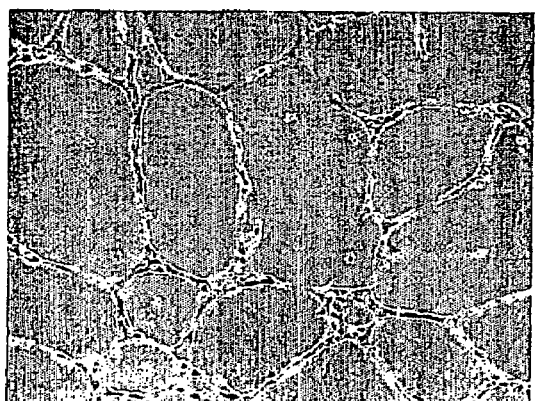

FIG. 10 shows that the expression of GS-V20, GS-V23, GS-V36, GS-V39 and GS-V41 in human endothelial cells inhibits the formation of capillary tubes. This Figure shows endothelial cells transfected with: 10A) GS-V20 coding for the specific antisense transcript of GS-N20; 10B) GS-V23 coding for the specific antisense transcript of GS-N23 and of its homologues GS-N47 and GS-N48; 10C) GS-V36 coding for the specific antisense transcript of GS-N36; 10D) GS-V39 coding for the specific antisense transcript of GS-N39; 10E) GS-V41 coding for the specific antisense transcript of GS-N41; and 10F) the empty vector.

Figure 11:
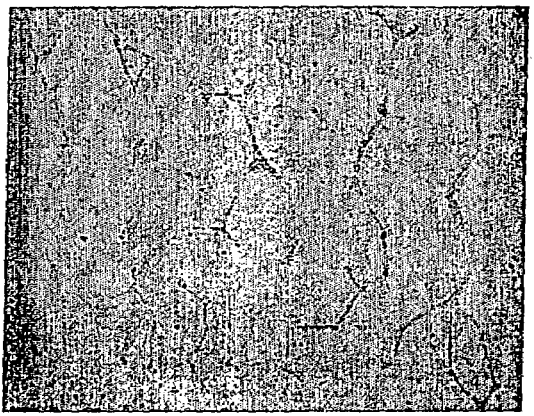
FIG. 11 is a photomicrograph of a human endothelial cell culture showing capillary tube formation upon transfection of cells with expression vectors 11A) GS-V46 and 11B) empty (control) vector.
Figure 11:
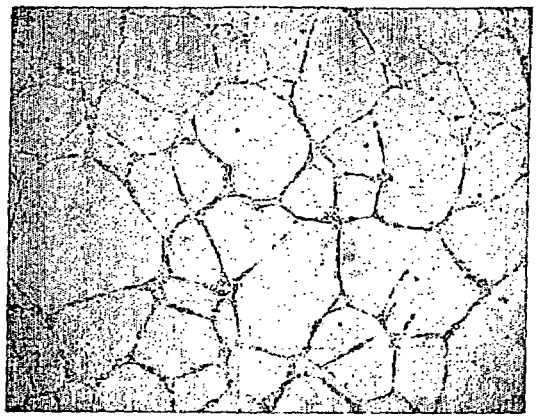

FIG. 11 shows that the expression of GS-V46 in human endothelial cells inhibits the formation of capillary tubes. This Figure shows endothelial cells transfected with: 11A) GS-V46 coding for the specific antisense transcript of GS-N46; and 11B) the empty vector (control).

The invention will now be illustrated by the following non-limiting examples.

EXAMPLES

Material and Methods

1. Culture of the Cells and Angiogenesis Test

Human endothelial cells from umbilical veins (HUVEC) grown under the following four culture conditions were used for identifying the genes coding for the cellular constituents implicated in the regulation of angiogenesis:

A control condition in which the endothelial cells are not stimulated.

An angiogenic condition in which the endothelial cells are stimulated by one or more angiogenic factors.

An angiogenesis inhibition condition in which the endothelial cells are stimulated by one or more angiogenic factors and brought into the presence of one or more angiostatic conditions.

Another control condition in which the endothelial cells are stimulated by one or more angiostatic factors.

The endothelial cells were maintained in complete medium (EGM-2 from Clonetics).

For the identification of the genes implicated in angiogenesis, the in vitro test of angiogenesis according to the model of Montesano et al. (1986, Proc. Natl. Acad. Sc. USA, 83(19): 7297-301, the entire disclosure of which is herein incorporated by reference) was used. Briefly, the cells were first sown on a gel type I collagen in complete medium until confluence. The reference HUVEC cells were then cultured on serum-impoverished medium without growth factors: EBM-2+2% serum and different factors were added under the test conditions, as follows:

FEG2: at concentrations between about 5 ng/ml and about 60 ng/ml, preferably between about 10 and about 40 ng/ml; VEGF: at concentrations between about 10 ng/ml and about 60 ng/ml, preferably between about 30 ng/ml and about 50 ng/ml; PF4: at concentrations between about 0.1 and about 5 µg/ml, preferably between about 0.5 µg/ml and about 1 µg/ml; TNF-α: at concentrations between about 20 ng/ml and about 100 ng/ml, preferably between about 30 ng/ml and about 60 ng/ml; IFN-γ: at concentrations between about 50 ng/ml and about 200 ng/ml, preferably between about 80 ng/ml and about 120 ng/ml.

The human endothelial cells placed under the four previously mentioned culture conditions were then used for identifying genes coding for the cellular constituents implicated in the regulation of angiogenesis.

2. Angiogenic and Angiostatic Factors

Angiogenic and angiostatic factors having an effect on the expression of the genes identified in correlation with the formation of neovessels or the inhibition of neovessels, respectively, used as an example in the framework of the present invention are illustrated below:

VEGF=vascular endothelial growth factor.
FGF2=basic fibroblast growth factor.
HGF=hepatocyte growth factor.
PF4=platelet factor 4.
IFN-γ=interferon gamma.
TNF-α=tumor necrosis factor alpha.

TNF-α is a regulator of angiogenesis. It can induce angiogenesis in vivo but also inhibit the formation of vessels in vitro (Frater-Schroder et al., 1987, Proc. Natl. Acad. Sci. USA, 84(15): 5277-81; Fajardo et al., 1992, Am. J. Pathol. Mar, 140 (3): 539-44; Niida et al., 1995, Neurol. Med. Chir. (Tokyo), 35(4): 209-14). In our in vitro model of angiogenesis, TNF-α is used under angiogenesis inhibition conditions.

3. Comparison of the Gene Expressions

Gene expression can be compared, for example, using the DNA chips, SAGE, an amplification reaction by quantitative PCR, viral vectors for constructing subtractive banks or analysis by differential display.

In the context of the experimental studies presented below, the differential display technique for the identification of said genes was preferentially used.

Differential Display

Total RNAs were prepared from HUVEC cells cultured on a collagen gel in the presence of the different factors used, according to the RNeasy Mini kit (Qiagen) integrating a step of DNase I digestion according to the protocol recommended by the manufacturer.

Differential display from total RNAs was performed according to the method described by Liang and Pardee (1992, Science, 14: 257(5072): 967-7) using αP33-ATP in isotopic dilution during the PCR amplification for the visualization of the bands by autoradiography of the electrophoresis gels.

Thus the DNA fragments differentially present on the gel as a function of the culture conditions were cut, reamplified, cloned in plasmid PGEM easy vector (Promega), sequenced and identified by querying the BLAST database.

4. Verification of the Implication of the Genes Identified in the Mechanism of Angiogenesis Functionality Test of the Genes In a second step, the functionality of each gene sequence identified was tested in the in vitro angiogenesis model discussed above with endothelial cells transfected with an expression vector comprising an antisense oligonucleotide of said sequence.

For the construction of these vectors, specific primers for each of the identified sequences were designed. These primers are indicated in Table I below, and are identified with the sequence numbers SEQ ID No. 195 to SEQ ID No. 222, SEQ ID No. 226 to SEQ ID No. 283 and SEQ ID No. 298 to SEQ ID No. 299 in the attached sequence listing.

TABLE I

| SEQUENCE ID | Primer name |
| --- | --- |
| SEQ ID No 1 (GS-N1) | GV1-1 |
|  | GV1-2 |
| SEQ ID No 2 (GS-N2) | GV2-1 |
|  | GV2-2 |
| SEQ ID No 3 (GS-N3) | GV3-1 |
|  | GV3-2 |
| SEQ ID No 4 (GS-N4) | GV4-1 |
|  | GV4-2 |
| SEQ ID No 5 (GS-N5) | GV5-1 |
|  | GV5-2 |
| SEQ ID No 6 (GS-N6) | GV6-1 |
|  | GV6-2 |
| SEQ ID No 7 (GS-N7) | GV7-1 |
|  | GV7-2 |
| SEQ ID No 8 (GS-N8) | GV8-1 |
|  | GV8-2 |
| SEQ ID No 9 (GS-N9) | GV9-1 |
|  | GV9-2 |
| SEQ ID No 10 (GS-N10) | GV10-1 |
|  | GV10-2 |
| SEQ ID No 11 (GS-N11) | GV11-1 |
|  | GV11-2 |
| SEQ ID No 12 (GS-N12) | GV12-1 |
|  | GV12-2 |
| SEQ ID No 13 (GS-N13) | GV13-1 |
|  | GV13-2 |
| SEQ ID No 14 (GS-N14) | GV14-1 |
|  | GV14-2 |

TABLE I-continued

| SEQUENCE ID | Primer name |
|---|---|
| SEQ ID No 15 (GS-N15) | GS-PGS-F |
|  | GS-PGM-R |
| SEQ ID No 16 (GS-N54) | GV10-1 |
|  | GV10-2 |
| SEQ ID No 17 (GS-N16) | GV16-1 |
|  | GV16-2 |
| SEQ ID No 18 (GS-N17) | GV17-1 |
|  | GV17-2 |
| SEQ ID No 19 (GS-N18) | GV18-1 |
|  | GV18-2 |
| SEQ ID No 20 (GS-N19) | GV19-1 |
|  | GV19-2 |
| SEQ ID No 21 (GS-N20) | GV20-1 |
|  | GV20-2 |
| SEQ ID No 22 (GS-N21) | GV21-1 |
|  | GV21-2 |
| SEQ ID No 23 (GS-N22) | GV22-1 |
|  | GV22-2 |
| SEQ ID No 24 (GS-N23) | GV23-1 |
|  | GV23-2 |
| SEQ ID No 25 (GS-N24) | GV24-1 |
|  | GV24-2 |
| SEQ ID No 26 (GS-N25) | GV25-1 |
|  | GV25-2 |
| SEQ ID No 27 (GS-N26) | GV26-1 |
|  | GV26-2 |
| SEQ ID No 28 (GS-N27) | GV27-1 |
|  | GV27-2 |
| SEQ ID No 29 (GS-N28) | GV28-1 |
|  | GV28-2 |
| SEQ ID No 30 (GS-N29) | GV29-1 |
|  | GV29-2 |
| SEQ ID No 31 (GS-N30) | GV30-1 |
|  | GV30-2 |
| SEQ ID No 32 (GS-N31) | GV31-1 |
|  | GV31-2 |
| SEQ ID No 33 (GS-N32) | GV32-1 |
|  | GV32-2 |
| SEQ ID No 34 (GS-N33) | GV33-1 |
|  | GV33-2 |
| SEQ ID No 35 (GS-N34) | GV34-1 |
|  | GV34-2 |
| SEQ ID No 36 GS-N35) | GV35-1 |
|  | GV35-2 |
| SEQ ID No 37 (GS-N36) | GV36-1 |
|  | GV36-2 |
| SEQ ID No 38 (GS-N37) | GV37-1 |
|  | GV37-2 |
| SEQ ID No 39 (GS-N38) | GV38-1 |
|  | GV38-2 |
| SEQ ID N° 40 (GS-N39) | GV39-1 |
|  | GV39-2 |
| SEQ ID No 41 (GS-N40) | GV40-1 |
|  | GV40-2 |
| SEQ ID No 42 (GS-N41) | GV41-1 |
|  | GV41-2 |
| SEQ ID No 43 (GS-N42) | GV42-1 |
|  | GV42-2 |
| SEQ ID No 44 (GS-N43) | GV43-1 |
|  | GV43-2 |
| SEQ ID No 45 (GS-N44) | GV44-1 |
|  | GV44-2 |
| SEQ ID No 46 (GS-N45) | GV45-1 |
|  | GV45-2 |
| SEQ ID No 47 (GS-N46) | GS-PGM-F |
|  | GS-PGS-R |
| SEQ ID No 48 (GS-N47) | GV23-1 |
|  | GV23-2 |
| SEQ ID No 49 (GS-N48) | GV23-1 |
|  | GV23-2 |
| SEQ ID No 50 (GS-N49) | GV24-1 |
|  | GV24-2 |
| SEQ ID No 51 (GS-N51) | GV27-1 |
|  | GV27-2 |
| SEQ ID No 52 (GS-N52) | GV29-1 |
|  | GV29-2 |
| SEQ ID No 53 (GS-N53) | GV31-1 |
|  | GV31-2 |
| SEQ ID No 225 (GS-N50) | GV50-1 |
|  | GV50-2 |

These primers contain, at each of their ends, a different restriction enzyme site (SalI: GTCGAC or MluI: ACGCGT).

Amplified fragments of each gene were obtained by PCR from each of the bacterial plasmids containing the fragment of the gene identified using said primers.

These fragments were purified, digested by the restriction enzymes SalI and MluI and inserted in a mammalian expression vector of the type pCi-neo vector (Promega), which is itself digested by one of these two restriction enzymes.

Each fragment was introduced in the antisense orientation.

In the particular cases of the GS-N15 and GSS-N46 sequences, the amplification of the fragment cloned in the bacterial plasmid was performed by means of particular primers selected from among the sequences GS-PGS-F, GS-PGM-R or GS-PGM-F and GS-PGS-R, hybridizing at the regions of the plasmid surrounding the cloned gene and also having in their ends restriction sites (SalI and MluI) not contained in the cloned fragment or present in the multisite region of the expression vector.

These two restriction sites could be interchanged, depending on whether the fragment was cloned in the bacterial plasmid in its sense or antisense orientation.

Controls performed with these primers, which can be considered universal primers, in the absence of the cloned gene (empty plasmid) showed that the amplified fragment of the plasmid (40 bp), when it is integrated in the expression vector, does not alter the formation of the neovessels in the in vitro functionality test. The results obtained with vectors constructed in this manner were identical to those obtained with the empty vector and show that these supplementary base pairs do not alter the effect of the specific antisense fragments of the identified sequence.

Generally speaking, vectors that can be used for demonstrating the functionality of the identified genes in the mechanisms of angiogenesis comprise any mammalian expression vector system. Suitable expression vectors can also comprise a promoter that enables expression of a cloned gene; for example, the strong promoter of human cytomegalovirus (CMV).

Other constitutive or inducible expression vectors that can be used in the present invention are specified in the nonexhaustive list below:

Vectors marketed by the company Promega; vectors with a strong promoter for a high level of expression constitutive of genes in mammal cells (pCI Mammalian Expression vector, Expression Vector System cloning vector pALTER®*-MAX); vectors marketed by the company Invitrogen: (pcDNA3.1, -/hygro, -/Zeo, pcDNA4/HisMAx, -E, pBudCE4, pRcRSV, pRcCMV2, pSecTag2, -/hygro secretion vectors, the vectors pEBVHis A, B and C); expression vectors for mammals marketed by the company Clontech (pIRES, pIRES-EYFP pIRES2-EGFP, pCMV-Myc and pCMV-HA); Epitope-tagged pTRE; the vectors VP16 Minimal Domain (ptTA 2, ptTA 3 and ptTA 4); the bidirectional Tet expression vectors (pBI, pBI-EGFP, pBI-G, pBI-L), pRevTRE, pTRE2, pLEGFP-N1 Retroviral Vector pLEGFP-C1; and the adenovirus expression systems Adeno-X, pCMS-EGFP, pd1EGFP-N1, pd2ECFP-N1, pd2EYFP-N1, pEGFP (-C1, -C2, -C3, -N1, -N2, -N3), pEYFP-C1, -N1.

Each vector comprising said antisense fragment was then replicated in E. coli, extracted, purified and quantified. One μg of each vector was incubated in the presence of a transfectant agent (Effectene, Qiagen) following the protocol recommended by the manufacturer for endothelial cells. Twenty-four hours after the transfection, the endothelial cells were trypsinized and spread on the extracellular matrix containing the angiogenic factors with Matrigel according to the model described by Grant et al. (1989, Cell, 58(5): 933-43, the entire disclosure of which is herein incorporated by reference). After 24 h of incubation, the formation of vessels was observed and compared to the control cells transfected with the empty mammalian expression vector.

5. Establishment of a Bank of Stable Lines Expressing the Vectors Containing the Gene Sequences or their Fragments or their Antisense Sequences The expression systems can comprise an antibiotic selection marker comprising an antibiotic resistance gene, for selecting the transfected cells, stably expressing the vector comprising the nucleic acid cloned in said vector—either in the same vector or in a second co-transfected vector.

This expression vector can be a constitutive or inducible expression system.

In the particular example described below, stable cell lines for the expression of the antisense oligonucleotide corresponding to each identified gene were obtained with a constitutive expression vector, after selection in presence of antibiotic.

In order to implement this selection, 24 h after the transfection performed under the conditions described above, the BAEC endothelial cells were trypsinized and sown at the rate of 80,000 cells/well in six-well plates in the presence of 700 μg/ml of the antibiotic G418 (Promega). A control well was sown with the untransfected cells. The medium was changed every three days with a recharge of the antibiotic. The control cells were eliminated after 8 to 10 days; the antibiotic-resistant cells were collected at confluence (after 2 to 3 weeks) then transferred into culture flasks, still in the presence of the antibiotic. The stable cell lines were then tested for their capacity to form or not form vessels in the in vitro angiogenesis test discussed above.

6. Results 6.1 Identification of the Genes

The nucleic acid sequences designated GS-N1, GS-N2, GS-N3, GS-N4, GS-N5, GS-N6, GS-N7, GS-N8, GS-N9, GS-N10 (or GS-N54), GS-N11, GS-N12, GS-N13, GN-14 and GS-N15, and respectively the proteins coded by said nucleic acids GS-N1 to GS-N13 and GS-N15 designated: angioinducine, angiodockine, angioblastine, angioreceptine, angiodensine, angiopartnerine, vassoserpentine, angiosulfatine, vassoreceptine, angiokinasine, vassosubstratine, angiosignaline, angiofoculine, angiohelicine and angioacyline, have not previously been identified as having any biological role, let alone in the process of angiogenesis or differentiation of endothelial cells into capillary tubes. These nucleic acids and proteins are described below.

The previously described differential display method enabled identification of the following mRNAs.

GS-N1: a 1683-bp mRNA identified by the sequence SEQ ID No. 1 in the attached sequence listing. A BLAST search on the GENBANK sequence database identified it as accession number BC008502.

The sequence of this mRNA has a coding sequence from the nucleotide 159 to the nucleotide 458. A protein GS-P1 resulting from the translation of this mRNA was thus identified. This protein is composed of 99 amino acids (aa), identified by the number SEQ ID No. 54 in the attached sequence listing and designated Angioinducine.

GS-N2: a 1649-bp mRNA identified by the sequence SEQ ID No. 2 in the attached sequence listing. A BLAST search on the GENBANK sequence database identified it as accession number NM_022823.

The sequence of this mRNA has a coding sequence from nucleotide 367 to nucleotide 1071. A protein GS-P2 resulting from the translation of this mRNA was thus identified. This protein is composed of 234 aa, identified by the number SEQ ID No. 55 in the attached sequence listing and designated Angiodockine.

GS-N3: a 5766-bp mRNA identified by the sequence SEQ ID No. 3 in the attached sequence listing. A BLAST search of the GENBANK sequence database identified it as accession number AB007963.

The sequence of this mRNA has a coding sequence from nucleotide 978 to nucleotide 2465. A protein GS-P3 resulting from the translation of this mRNA was thus identified. This protein is composed of 495 aa, identified by the number SEQ ID No. 56 in the attached sequence listing and designated Angioblastine.

GS-N4: a 5242-bp mRNA identified by the sequence SEQ ID No. 4 in the attached sequence listing. A BLAST search on the GENBANK sequence database identified it by the accession number AB037835.

The sequence of this mRNA has a partial coding sequence from nucleotide 1 to nucleotide 4762. A protein GS-P4 resulting from the translation of this mRNA was thus identified. This protein is composed of 1586 aa, identified by the number SEQ ID No. 57 in the attached sequence listing and designated Angioreceptine.

GS-N5: a 2153-bp mRNA identified by the sequence SEQ ID No. 5 in the attached sequence listing. A BLAST search on the GENBANK sequence database identified it by the accession number AK025682.

The sequence of this mRNA has a coding sequence from nucleotide 39 to nucleotide 691. A protein GS-P5 resulting from the translation of this mRNA was thus identified. This protein is composed of 217 aa, identified by the number SEQ ID No. 58 in the attached sequence list and designated Angiodensine.

GS-N6: a 3005-bp mRNA identified by the sequence SEQ ID No. 6 in the attached sequence listing. A BLAST search on the GENBANK database identified it as accession number AK023284.

The sequence of this mRNA has a coding sequence from nucleotide 90 to nucleotide 773. A protein GS-P6 resulting from the translation of this mRNA was thus identified. This protein is composed of 227 aa, identified by the number SEQ ID No. 59 in the attached sequence listing and designated Vassoserpentine.

GS-N7: a 4397-bp mRNA identified by the sequence SEQ ID No. 7 in the attached sequence listing. A BLAST search on the GENBANK sequence database identified it as accession number AB033073.

The sequence of this mRNA has a partial coding sequence from nucleotide 286 to nucleotide 2943. A protein GS-P7 resulting from the translation of this mRNA was thus identified. This protein is composed of 885 aa, identified by the number SEQ ID No. 60 in the attached sequences listing and designated Angiosulfatine.

GS-N8: a 5844-bp mRNA identified by the sequence SEQ ID No. 8 in the attached sequence listing. A BLAST search on the GENBANK sequence database identified it as accession number AB023187.

The sequence of this mRNA has a partial coding sequence from nucleotide 1 to nucleotide 3456. A protein GS-P8 resulting from the translation of this mRNA was thus identified. This protein is composed of 1151 aa, identified by the number SEQ ID No. 61 in the attached sequence listing and designated Vassoreceptine.

GS-N9: a 4266-bp mRNA identified by the sequence SEQ ID No. 9 in the attached sequence listing. A BLAST search on the GENBANK sequence database identified it as accession number AB014587.

The sequence of this mRNA has a partial coding sequence from nucleotide 1 to nucleotide 3528. A protein GS-P9 resulting from the translation of this mRNA was thus identified. This protein is composed of 1175 aa, identified by the number SEQ ID No. 62 in the attached sequence listing and designated Angiokinasine.

Angiokinasine is homologous with MAP4K4 (SEQ ID No. 224 in the attached sequence listing), accession number: XM_038751 (nucleic sequence: 4197 bp, protein sequence: 1141 aa). Thus, the present invention provides a heretofore unknown role for MAP4K4 in the regulation f angiogenesis.

GS-N10: a 2034-bp mRNA identified by the sequence SEQ ID No. 10 in the attached sequence listing. A BLAST search on the GENBANK sequence database identified it as accession number XM_035658.

This sequence is homologous with the sequence GS-N54.

GS-N54: a 4749-bp mRNA identified by the sequence SEQ ID No. 16 in the attached sequence listing. A BLAST search on the GENBANK sequence database identified as accession number AK024248.

The sequence of mRNA GS-N10 has a coding sequence from nucleotide 618 to nucleotide 1787. A protein GS-P10 resulting from the translation of this mRNA was thus identified. This protein is composed of 389 aa, identified by the number SEQ ID No. 63 in the attached sequence listing and designated Vassosubstratine.

GS-N11: a 1817-bp mRNA identified by the sequence SEQ ID No. 11 in the attached sequence listing. A BLAST search on the GENBANK sequence database identified it as accession number NM_032181.

The sequence of this mRNA has a coding sequence from nucleotide 439 to nucleotide 897. A protein GS-P11 resulting from the translation of this mRNA was thus identified. This protein is composed of 152 aa, identified under the number SEQ ID No. 64 in the attached sequence listing and designated Angiosignaline.

GS-N12: a 4131-bp mRNA identified by the sequence SEQ ID No. 12 in the attached sequence listing. A BLAST search on the GENBANK sequence database identified it as accession number AB023233.

The sequence of this mRNA has a partial coding sequence from nucleotide 1 to nucleotide 2834. A protein GS-P12 resulting from the translation of this mRNA was thus identified. This protein is composed of 793 aa, identified under the number SEQ ID No. 65 in the attached sequence listing and designated Angiofoculine.

GS-N13: a 2566-bp mRNA identified by the sequence SEQ ID No. 13 in the attached sequence listing. A BLAST search on the GENBANK sequence database identified it as number XM_018273.

The sequence of this mRNA has a coding sequence from nucleotide 426 to nucleotide 2345. A protein GS-P13 resulting from the translation of this mRNA was thus identified. This protein is composed of 639 aa, identified by the number SEQ ID No. 66 in the attached sequence listing and designated Angiohelicine.

GS-N14: a 1830-bp mRNA identified by the sequence SEQ ID No. 14 in the attached sequence listing. A BLAST search on the GENBANK sequence data base identified it as accession number AK022109.

This sequence does not contain a coding sequence.

GS-N15: a 6253-bp mRNA identified by the sequence SEQ ID No. 15 in the attached sequence listing. A BLAST search on the GENBANK sequence database identified it as accession number NM_014873.

The sequence of this mRNA has a coding sequence from nucleotide 228 to nucleotide 1340. A protein GS-P15 resulting from the translation of this mRNA was thus identified. This protein is composed of 370 aa, identified under the number SEQ ID No. 67 in the attached sequence listing and designated Angioacyline.

The nucleic acid sequences designated GS-N16 to GS-N53 identified by the numbers SEQ ID No. 17 to SEQ ID No. 53 and SEQ ID No. 225 in the attached sequence listing, and respectively the proteins coded by said nucleic acids, identified by the numbers SEQ ID No. 68 to SEQ ID No. 102 in the attached sequence listing, had not previously been identified as having a biological role in the process of angiogenesis or the differentiation of endothelial cells into capillary tubes. These sequences are described below.

GS-N16: a 3139-bp mRNA identified by the sequence number SEQ ID No. 17 in the attached sequence listing. A BLAST search of the GENBANK sequence database identified it as accession number XM_011833 (*Homo sapiens* phosducin-like (PDCL)).

The sequence of this mRNA has a coding region from nucleotide 167 to nucleotide 1072. A protein GS-P16 resulting from the translation of this mRNA was thus identified.

This protein whose sequence is identified by the number SEQ ID No. 68 in the attached sequence listing is an analogue of the phosducin designated PDCL composed of 301 aa.

GS-N17: a 2326-bp mRNA identified as sequence number SEQ ID No. 18 in the attached sequence listing. A BLAST search of the GENBANK sequence database identified it as access number BC011860 (Ribosome Protein L3 (RPL3)).

The sequence of this mRNA has a coding sequence from nucleotide 1030 to 2241 identified by number SEQ ID No. 69 in the attached sequence listing. The polypeptide sequence of 403 aa is identical (100% identity) to the human ribosome protein L3 (RPL3) whose nucleic sequence is shorter, accession number BC006483 (SEQ ID No. 285), BC012786 (SEQ ID No. 286).

The ribosome protein L3 (RPL3) is a highly conserved protein (Herwig et al., 1992, Eur. J. Biochem. 207(3): 877-85; Van Raay et al., 1996, Genomics: 37(2): 172-6) localized in the large ribosome subunit. In *E. coli* this protein is known to bind ribosome RNA 23S and participate in the formation of the peptidyltransferase center of this ribosome (Noller, 1993, Bacteriol. 175: 5297-53039; Noller, 1997, Ann. Rev. Biochem. 66: 679-716).

Although the differential expression of the ribosome protein L3 has been demonstrated in many studies: in skeletal muscle in an obesity study model in the mouse (Vicent et al., 1998, Diabetes 47: 1451-8), in the hypothalamus and brown adipose tissues in the mouse implicating RLP3 in the regulation of energy equilibrium (Allan et al., 2000, Physiological Genomics, 3: 149-156), there have been no descriptions of differential expression during angiogenesis nor in the regulation of angiogenesis.

GS-N18: a 3937-bp mRNA identified as sequence number SEQ ID No. 19 in the attached sequence listing. A BLAST search of the GENBANK sequence database identified it as accession number XM_042798 (Protein 20 RING FINGER protein 20 (RNF20)).

This mRNA presents a coding sequence from nucleotide 89 to nucleotide 3016. Its direct translation enables identification of a protein homologous with the protein RNF20 composed of 975 aa (GS-P 18), identified by the number SEQ ID No. 70 in the attached sequence listing.

This sequence GS-P18 presents a total identity with the protein sequence deduced from the nucleotide sequence identified by accession number AF265230 in the GENBANK database and by the number SEQ ID No. 287 in the attached sequence listing. The nucleotide sequences corresponding to the two proteins present a homology of 99% with each other.

The protein RNF20 is still poorly understood but it is characterized by the presence of the RING FINGER domain. The ring finger proteins could play a role in the formation and architecture of large protein complexes that contribute to various cellular processes, such as transduction of the signal, oncogenesis, apoptosis, development, differentiation, regulation of genes, ubiquination (Saurin et al., 1996, Trends Biochem. Sci. 21, 208-214; Borden, 2000, J. Mol. Biol., 295, 1103-1112; Topcu et al., 1999, Oncogene 18, 7091-7100).

It has not been described to date that the protein RNF20 is implicated in the regulation of angiogenesis.

GS-N19: a 2167-bp mRNA identified by number SEQ ID No. 20 in the attached sequence listing. A BLAST search of the GENBANK sequence database identified it as accession number BC002781 (protein analogue of the splice factor, arginine/serine-rich 4).

The sequence of this mRNA presents a coding region from nucleotide 107 to nucleotide 1591. A protein GS-P19 resulting from the translation of this mRNA, presented as the number SEQ ID No. 71 in the attached sequence listing, was thus identified. This protein, composed of 494 aa, is homologous with the splice factor arginine/serine-rich 4 (SFRS4) (which is also called SRp75) and presents the same characteristic domains.

GS-N20: a 5801-bp mRNA identified as number SEQ ID No. 21 in the attached sequence listing. A BLAST search of the GENBANK sequence database identified it as accession number U65090 (carboxypeptidase D).

The sequence of this mRNA has a coding region from nucleotide 36 to nucleotide 4169. A protein GS-P21, stemming from the direct translation of this mRNA, presented as number SEQ ID No. 72 in the attached sequence listing, was thus identified. This protein, called carboxypeptidase D, is composed of 1377 aa.

GS-N21: a 8171-bp mRNA identified as number SEQ ID No. 22 in the attached sequence listing. A BLAST search of the GENBANK sequence database identified it as accession number NM_004652 (protease 9 specific of ubiquitin).

The sequence of this mRNA has a coding sequence from nucleotide 60 to nucleotide 7751. There was thus identified a protein resulting from the translation of this mRNA. This protein, designated GS-P21, protease 9 specific of ubiquitin, is composted of 2563 aa. It is identified as number SEQ ID No. 73 in the attached sequence listing.

GS-N22: a 3851-bp mRNA identified as number SEQ ID No. 23 in the attached sequence listing. A BLAST search of the GENBANK sequence database identified it as accession number NM_002525 (nardilysine (N-arginine dibasic convertase) (NRD1)).

GS-N23: a 13,107-bp mRNA identified by the number SEQ ID No. 24 in the attached sequence listing. A BLAST search of the GENBANK sequence database identified it as accession number XM_016303 (mRNA of myeloid/lymphoid or mixed lineage leukemia (MLL)).

The mRNA sequence identified by the number SEQ ID No. 24 has a coding sequence from nucleotide 1872 to nucleotide 10,001. A protein GS-P23 resulting from the translation of this mRNA was thus identified. This protein, designated MLL, is composed of 2709 aa. It is identified as number SEQ ID No. 75 in the attached sequence listing.

This sequence GS-N23 presents at least 86% homology with the following sequences:

GS-N47: a 14,255-bp mRNA identified as number SEQ ID No. 48 in the attached sequence listing. A BLAST search of the GENBANK sequence database identified it as accession number L04731.

This mRNA sequence does not have a coding sequence. It comprises the sequence GS-N23 with a homology of 90%.

GS-N48: a 11,910-bp mRNA identified as number SEQ ID No. 49 in the attached sequence listing. A BLAST search of the GENBANK database identified it as accession number NM_005933.

The mRNA sequence identified by the number SEQ ID No. 48 has a coding sequence from nucleotide 1 to nucleotide 11910. A protein GS-P43 resulting from the translation of this mRNA was thus identified. This protein, designated MLL, is composed of 3969 aa. It is identified by the number SEQ ID No. 99 in the attached sequence listing.

GS-N24: a 10,330-bp mRNA identified by the number SEQ ID No. 25 in the attached sequence listing. A BLAST search of the GENBANK sequence database identified it as accession number U72937 (DNA-dependent helicase and ATPase (ATRX), product 2 of the alternative splice).

This sequence is homologous with at least 95% identity of the sequence:

GS-N49: a 10,452-bp mRNA identified by the number SEQ ID No. 50 in the attached sequence listing. A BLAST search of the GENBANK sequence database identified it as accession number U72936.

The mRNA sequence identified by the number SEQ ID No. 25 has a coding sequence from nucleotide 216 to nucleotide 7694. A protein GS-P24 resulting from the translation of this mRNA was thus identified. This protein, designated ATRX product 2, is composed of 2492 aa. It is identified by the number SEQ ID No. 76 in the attached sequence listing.

The mRNA sequence identified by the number SEQ ID No. 50 has a coding sequence from nucleotide 950 to nucleotide 7816. A protein GS-P49 resulting from the translation of this mRNA was thus identified. This protein, designated ATRX product 1, is composed of 2288 aa. It is identified by the number SEQ ID No. 100 in the attached sequence listing.

The proteins identified by the numbers SEQ ID No. 76 and 100 are homologous at the level of 90%.

GS-N25: a 1777-bp mRNA identified by the number SEQ ID No. 26 in the attached sequence listing. A BLAST search of the GENBANK sequence database identified it as accession number NM_006476 (sialic acid transporter-CMP, member 1 (SLC35A1)).

The sequence of this mRNA has a coding sequence from nucleotide 28 to nucleotide 1041. A protein GS-P25 resulting from the translation of this mRNA was thus identified. This protein, designated sialic acid transporter-CMP is composed of 337 aa. It is identified by the number SEQ ID No. 77 in the attached sequence listing.

GS-N50: a 1874-bp mRNA identified by the number SEQ ID No. 225 in the attached sequence listing. A BLAST search of the GENBANK sequence database identified it as accession number BC008372. The mRNA sequence identified by the number SEQ ID No. 225 does not have a coding sequence.

GS-N26: a 3982-bp mRNA identified by the number SEQ ID No. 27 in the attached sequence listing. A BLAST search of the GENBANK sequence database identified it as accession number U26710.

The sequence of this mRNA has a coding sequence from nucleotide 323 to nucleotide 3271. A protein GS-P26 resulting from the translation of this mRNA was thus identified. This protein, designated Cbl-b, is composed of 982 aa. It is identified by the number SEQ ID No. 78 in the attached sequence listing.

GS-N27: a 3385-bp mRNA identified by the number SEQ ID No. 28 in the attached sequence listing. A BLAST search of the GENBANK sequence database identified it as accession number XM_39529.

This sequence presents 86% homology with the following sequence:

A 4461-bp cDNA (DKFZp564D173) identified by the number SEQ ID No. 51 in the attached sequence listing. A BLAST search of the GENBANK sequence database identified it as accession number AL110212. There is no corresponding coding sequence.

The mRNA sequence identified by the number SEQ ID No. 27 has a coding sequence from nucleotide 107 to nucleotide 451. A protein GS-P27 resulting from the translation of this mRNA was thus identified. This protein, designated histone H2A.F/Z variant (H2AV), is composed of 114 aa. It is identified by the number SEQ ID No. 79 in the attached sequence listing.

GS-N28: a 1128-bp mRNA identified as number SEQ ID No. 29 in the attached sequence listing. A BLAST search of the GENBANK sequence database identified it as accession number NM_001320.

This sequence has 77% homology with the sequence identified under the accession number M30448 in the GENBANK database and identified by number SEQ ID No. 289 in the attached sequence listing.

The sequence of this mRNA has a coding sequence from nucleotide 97 to nucleotide 744. A protein GS-P28 resulting from the translation of this mRNA was thus identified. This protein, designated casein kinase II, subunit beta, is composed of 215 aa. It is identified by the number SEQ ID No. 80 in the attached sequence listing.

GS-N29: a 18,207-bp mRNA identified by the number SEQ ID No. 30 in the attached sequence listing. A BLAST search in the GENBANK sequence database identified it as accession number AF156100.

The sequence of this mRNA has a coding sequence from nucleotide 230 to nucleotide 17140. A protein GS-P29 resulting from the translation of this mRNA was thus identified. This protein, designated hemicentine, is composed of 5636 aa. It is identified by the number SEQ ID No. 81 in the attached sequence listing.

This sequence GS-29 comprises the sequence GS-N52 below, presenting a homology of 99% with it.

GS-N52: a 8546-bp mRNA identified by the number SEQ ID No. 52 in the attached sequence listing. A BLAST search of the GENBANK sequence database identified it as accession number AJ306906.

The sequence of this mRNA has a sequence coding for a protein GS-P52 of 2673 aa identified by the number SEQ ID No. 101 in the attached sequence listing.

GS-N30: a 4325-bp mRNA identified by the number SEQ ID No. 31 in the attached sequence listing. A BLAST search of the GENBANK sequence database identified it as accession number NM_015180.

The sequence of this mRNA has a coding sequence from nucleotide 123 to nucleotide 3041. A protein GS-P30 resulting from the translation of this mRNA was thus identified. This protein, designated SYNE-2, is composed of 1092 aa. It is identified by the number SEQ ID No. 82 in the attached sequence listing.

GS-N31: a 4248-bp mRNA identified by the number SEQ ID No. 32 in the attached sequence listing. A BLAST search of the GENBANK sequence database identified it as accession number AF261758.

The sequence of this mRNA has a coding sequence from nucleotide 100 to nucleotide 1650. A protein GS-P31 resulting from the translation of this mRNA was thus identified. This protein, designated seladine-1, is composed of 516 aa. It is identified as number SEQ ID No. 83 in the attached sequence listing.

This mRNA sequence identified as number SEQ ID No. 32 in the attached sequence listing is homologous with a 4187-bp sequence. A BLAST search of the GENBANK sequence database identified it as accession number D13643. It is identified under the number SEQ ID No. 53 in the attached sequence listing.

This mRNA presents a partial coding sequence. A protein GS-P53 of 528 aa resulting from the translation of this mRNA was thus identified. It is identified as number SEQ ID No. 102 in the attached sequence listing.

GS-N32: a 7764-bp mRNA identified by the number SEQ ID No. 33 in the attached sequence listing. A BLAST search of the GENBANK sequence database identified it as accession number NM_001271.

The sequence of this mRNA has a coding sequence from nucleotide 708 to nucleotide 5927. A protein GS-P32 resulting from the translation of this mRNA was thus identified. This protein, designated CHD2, is composed of 1739 aa. It is identified by the number SEQ ID No. 84 in the attached sequence listing.

GS-N33: a 4693-bp mRNA identified by number SEQ ID No. 34 in the attached sequence listing. A BLAST search of the GENBANK sequence database identified it as accession number XM_04255.

The sequence of this mRNA has a coding sequence from nucleotide 1702 to nucleotide 4107. A protein GS-P33 resulting from the translation of this mRNA was thus identified. This protein, designated BRD2, is composed of 801 aa. It is identified by the number SEQ ID No. 85 in the attached sequence listing.

GS-N34: a 2983-bp mRNA identified by the number SEQ ID No. 35 in the attached sequence listing. A BLAST search of the GENBANK sequence database identified it as accession number BC007429.

The sequence of this mRNA has a coding sequence from nucleotide 200 to nucleotide 1069. A protein GS-P34 resulting from the translation of this mRNA was thus identified. This protein, designated syntaxin 3A, is composed of 289 aa. It is identified by the number SEQ ID No. 86 in the attached sequence listing.

GS-N35: a 12,227-bp mRNA identified by the number SEQ ID No. 36 in the attached sequence listing. A BLAST search of the GENBANK sequence database identified it as accession number NM_015001.

The sequence of this mRNA has a coding sequence from nucleotide 205 to nucleotide 11,199. A protein GS-P35 resulting from the translation of this mRNA was thus identified. This protein, designated SHARP, is composed of 3664 aa. It is identified by the number SEQ ID No. 87 in the attached sequence listing.

GS-N36: a 5376-bp mRNA identified by the number SEQ ID No. 37 in the attached sequence listing. A BLAST search of the GENBANK sequence database identified it as accession number AF352051.

The sequence of this mRNA has a coding sequence from nucleotide 92 to nucleotide 4692. A protein GS-P36 resulting from the translation of this mRNA was thus identified. This protein, designated proliferation potential-related protein, is composed of 1616 aa. It is identified as number SEQ ID No. 88 in the attached sequence listing.

This sequence identified by the number SEQ ID No. 37 presents 92% homology with the sequence coding for the protein RPBB6 (retinoblastoma-binding protein 6) of 948 aa identified by the number SEQ ID No. 288 in the attached sequence listing. The nucleotide sequence corresponding to this protein comprises 2994 bp and the accession number NM_006910 in the GENBANK sequence database.

GS-N37: a 6626-bp mRNA identified by the number SEQ ID No. 38 in the attached sequence listing. A BLAST search of the GENBANK sequence database identified it as accession number XM_005338.

The sequence of this mRNA has a coding sequence from nucleotide 245 to nucleotide 2989. A protein GS-P37 resulting from the translation of this mRNA was thus identified. This protein, designated protein HIP1, is composed of 914 aa. It is identified by the number SEQ ID No. 89 in the attached sequence listing.

GS-N38: a 2366-bp mRNA identified by the number SEQ ID No. 39 in the attached sequence listing. A BLAST search of the GENBANK sequence database identified it as accession number BC000335.

The sequence of this mRNA has a coding sequence from nucleotide 12 to nucleotide 2237. A protein GS-P38 resulting from the translation of this mRNA was thus identified. This protein, designated nucleoporin 88 kDa, is composed of 741 aa. It is identified by the number SEQ ID No. 90 in the attached sequence listing.

GS-N39: a 1543-bp mRNA identified by the number SEQ ID No. 40 in the attached sequence listing. A BLAST search of the GENBANK sequence database identified it as accession number XM_049486.

The sequence of this mRNA has a coding sequence from nucleotide 86 to nucleotide 412. A protein GS-P39 resulting from the translation of this mRNA was thus identified. This protein, designated FK506 binding protein, is composed of 108 aa. It is identified by the number SEQ ID No. 91 in the attached sequence listing.

GS-N40: a 3824-bp mRNA identified by the number SEQ ID No. 41 in the attached sequence listing. A BLAST search of the GENBANK sequence database identified it as accession number XM_042827.

The sequence of this mRNA has a coding sequence from nucleotide 115 to nucleotide 3663. A protein GS-P40 resulting from the translation of this mRNA was thus identified. This protein, designated SALF protein, is composed of 1182 aa. It is identified by the number SEQ ID No. 92 in the attached sequence listing.

GS-N41: a 1365-bp mRNA identified by the number SEQ ID No. 42 in the attached sequence listing. A BLAST search of the GENBANK sequence database identified it as accession number BC010862.

The sequence of this mRNA has a coding sequence from nucleotide 277 to nucleotide 758. A protein GS-P41 resulting from the translation of this mRNA was thus identified. This protein is composed of 243 aa and is identified by the number SEQ ID No. 93 in the attached sequence listing.

GS-N42: a 6147-bp mRNA identified by the number SEQ ID No. 43 in the attached sequence listing. A BLAST search of the GENBANK sequence database identified it as accession number NM_013390.

The sequence of this mRNA has a coding sequence from nucleotide 149 to nucleotide 4300. A protein GS-P42 resulting from the translation of this mRNA was thus identified. This protein, designated TMEM2, is composed of 1383 aa. It is identified by the number SEQ ID No. 94 in the attached sequence listing.

GS-N43: a 4357-bp mRNA identified by the number SEQ ID No. 44 in the attached sequence listing. A BLAST search of the GENBANK sequence database identified it as accession number AB029316.

The sequence of this mRNA has a coding sequence from nucleotide 318 to nucleotide 2834. A protein GS-P43 resulting from the translation of this mRNA was thus identified. This protein, designated Dorfin, is composed of 838 aa. It is identified by the number SEQ ID No. 95 in the attached sequence listing.

GS-N44: a 1801-bp mRNA identified by the number SEQ ID No. 45 in the attached sequence listing. A BLAST search of the GENBANK sequence database identified it under the accession number XM_032382 (member 2 of the transmembranous superfamily 4).

The sequence of this mRNA has a coding sequence from nucleotide 81 to nucleotide 815. A protein GS-P44 resulting from the translation of this mRNA was thus identified. This protein, designated TM4SF2, is composed of 244 aa. It is identified by the number SEQ ID No. 96 in the attached sequence listing.

GS-N45: a 2801-bp mRNA identified by the number SEQ ID No. 46 in the attached sequence listing. A BLAST search of the GENBANK sequence database identified it as accession number HSA133133.

The sequence of this mRNA has a coding sequence from nucleotide 184 to nucleotide 1737. A protein GS-P45 resulting from the translation of this mRNA was thus identified. This protein, designated Ecto-ATP diphosphohydralase I, is composed of 517 aa. It is identified by number SEQ ID No. 97 in the attached sequence listing.

CD39 and ecto-ATPDASE I could be two forms resulting from the alternative splicing of the same gene. The vector coding for the antisense oligonucleotide used in our study can inhibit the expression of both CD39 and ecto-ATPDase I.

The results obtained with the vector GS-V45 in the framework of the present invention show that CD39 plays a direct role in angiogenesis.

It should also be noted that no role has been described to date for ecto-ATPDase I in the regulation of angiogenesis.

GS-N46: a 4332-bp mRNA identified by the number SEQ ID No. 47 in the attached sequence listing. A BLAST search of the GENBANK sequence database identified it as accession number AJ306399.

The sequence of this mRNA has a coding sequence from nucleotide 56 to nucleotide 1828. A protein GS-P46 resulting from the translation of this mRNA was thus identified. This protein is composed of 590 aa. It is identified by the number SEQ ID No. 98 in the attached sequence listing.

The expression of the mRNAs identified above is observed in human endothelial cells that form capillary tubes. The present invention thus demonstrates that the differential expression of the gene corresponding to each of these mRNA accompanies the formation of neovessels by the endothelial cells.

Moreover, it is demonstrated herein that the induction of expression of said genes during angiogenesis is sensitive to the presence of different inhibitors. In fact, when human endothelial cells forming neovessels are stimulated by an angiogenic factor (indicated in column 2 of table II), one observes an elevated expression of this mRNA whereas when the same human endothelial cells are stimulated by the same angiogenic factor and brought into the presence of an anti-angiogenic factor (indicated in column 3 of table II) (where angiogenesis is inhibited) one observes that the expression of this gene is also inhibited.

TABLE II

| SEQ. ID | Inducers of expression | Inhibitors of expression |
|---|---|---|
| SEQ ID No 1 (GS-N1) | VEGF | PF4 |
| SEQ ID No 2 (GS-N2) | VEGF | PF4 |
| SEQ ID No 3 (GS-N3) | FGF2 | IFN-gamma |
| SEQ ID No 4 (GS-N4) | VEGF | IFN-gamma |
| SEQ ID No 5 (GS-N5) | VEGF | IFN-gamma |
| SEQ ID No 6 (GS-N6) | VEGF | IFN-gamma |
| SEQ ID No 7 (GS-N7) | VEGF | TNF-alpha |
| SEQ ID No 8 (GS-N8) | VEGF | TNF-alpha |
| SEQ ID No 9 (GS-N9) | VEGF | IFN-gamma |
| SEQ ID No 10 (GS-N10) | VEGF | IFN-gamma |
| SEQ ID No 11 (GS-N11) | VEGF | IFN-gamma |
| SEQ ID No 12 (GS-N12) | VEGF | IFN-gamma |
| SEQ ID No 13 (GS-N13) | VEGF | IFN-gamma |
| SEQ ID No 14 (GS-N14) | VEGF | IFN-gamma |
| SEQ ID No 15 (GS-N15) | VEGF | IFN-gamma |
| SEQ ID No 17 (GS-N16) | VEGF | PF4 |
| SEQ ID No 18 (GS-N17) | VEGF | TSP-1 |
| SEQ ID No 19 (GS-N18) | VEGF | PF4 |
| SEQ ID No 20 (GS-N19) | VEGF | PF4 |
| SEQ ID No 21 (GS-N20) | VEGF | PF4 |
| SEQ ID No 22 (GS-N21) | VEGF | PF4 |
| SEQ ID No 23 (GS-N22) | VEGF | PF4 |
| SEQ ID No 24 (GS-N23) | FGF2 | TNF-alpha |
| SEQ ID No 25 (GS-N24) | VEGF | IFN-gamma |
| SEQ ID No 26 (GS-N25) | VEGF | IFN-gamma |
| SEQ ID No 27 (GS-N26) | VEGF | IFN-gamma |
| SEQ ID No 28 (GS-N27) | VEGF | IFN-gamma |
| SEQ ID No 29 (GS-N28) | VEGF | IFN-gamma |
| SEQ ID No 30 (GS-N29) | FGF2 | Ang-2 |
| SEQ ID No 31 (GS-N30) | VEGF | TNF-alpha |
| SEQ ID No 32 (GS-N31) | VEGF | IFN-gamma |
| SEQ ID No 33 (GS-N32) | VEGF | TNF-alpha |
| SEQ ID No 34 (GS-N33) | VEGF | IFN-gamma |
| SEQ ID No 35 (GS-N34) | VEGF | TNF-alpha |
| SEQ ID No 36 GS-N35) | VEGF | IFN-gamma |
| SEQ ID No 37 (GS-N36) | VEGF | IFN-gamma |
| SEQ ID No 38 (GS-N37) | FGF2 | Ang-2 |
| SEQ ID No 39 (GS-N38) | VEGF | IFN-gamma |
| SEQ ID N° 40 (GS-N39) | VEGF | IFN-gamma |
| SEQ ID No 41 (GS-N40) | VEGF | IFN-gamma |
| SEQ ID No 42 (GS-N41) | VEGF | IFN-gamma |
| SEQ ID No 43 (GS-N42) | VEGF | Ang-2 |
| SEQ ID No 44 (GS-N43) | FGF2 | PF4 |

TABLE II-continued

| SEQ. ID | Inducers of expression | Inhibitors of expression |
|---|---|---|
| SEQ ID No 45 (GS-N44) | FGF2 | IFN-gamma |
| SEQ ID No 46 (GS-N45) | VEGF | IFN-gamma |
| SEQ ID No 47 (GS-N46) | FGF2 | TNF-alpha |
| SEQ ID No 48 (GS-N47) | FGF2 | TNF-alpha |
| SEQ ID No 49 (GS-N48) | FGF2 | TNF-alpha |
| SEQ ID No 50 (GS-N49) | VEGF | IFN-gamma |
| SEQ ID No 51 (GS-N51) | VEGF | IFN-gamma |
| SEQ ID No 52 (GS-N52) | FGF2 | Ang-2 |
| SEQ ID No 53 (GS-N53) | VEGF | TNF-alpha |
| SEQ ID No 225 (GS-N50) | VEGF | IFN-gamma |
| SEQ ID No 16 (GS-N54) | VEGF | IFN-gamma |

It thus appears that there exists a direct correlation between the expression of each of the genes GS-N1 to GS-N54 and the angiogenic state of the human endothelial cells.

6.2 Verification of the Role of the Identified Genes in the Regulation of Angiogenesis.

Moreover, the functional role of the above-described genes in the formation of neovessels by human endothelial cells has been demonstrated herein.

In fact, an oligonucleotide specific of each of the identified genes, selected from among the oligonucleotides identified by the sequences SEQ ID No. 103 to SEQ ID No. 148 in the attached sequence listing, was introduced into the expression vector pCI-neo vector in the antisense orientation.

The resultant vectors, designated GS-V1 to GS-V46 and identified by their sequence SEQ ID No. 149 to SEQ ID No. 194 in the attached sequence listing, were used to repress the expression of the gene coding for this mRNA in human endothelial cells subsequent to the transfection of these cells by this vector.

The human endothelial cells were then stimulated by the angiogenic factors. The results obtained for each of the sequences illustrated below, using the antisense sequences and the corresponding vectors, indicated in Table III, shows that:

the repression of the expression of the genes SEQ ID No. 1 to SEQ ID No. 5, SEQ ID No. 7, SEQ ID No. 9, SEQ ID No. 11 to SEQ ID No. 15, SEQ ID No. 17 to SEQ ID No. 53 and SEQ ID No. 225 inhibit the formation of neovessels by the human endothelial cells; and that the repression of the genes SEQ ID No. 6, SEQ ID No. 8, SEQ ID No. 10 and SEQ ID No. 16 stimulates the formation of neovessels by the human endothelial cells despite the presence of the different angiogenic factors.

These results are also illustrated in the attached FIGS. 1 to 11.

TABLE III

| | Genes Name SEQ. ID | Proteins SEQ. ID | Antisense sequences | Vector with antisense inserted | Fig. | Control Fig. |
|---|---|---|---|---|---|---|
| 1 | SEQ ID No 1 (GS-N1) | SEQ ID No 54 (GS-P1) Angioinducine | SEQ ID No 103 (257 pb) | SEQ ID No 149 (GS-V1) | 1A | 1F |
| 2 | SEQ ID No 2 (GS-N2) | SEQ ID No 55 (GS-P2) Angiodockine | SEQ ID No 104 (202 pb) | SEQ ID No 150 (GS-V2) | 1B | 1F |
| 3 | SEQ ID No 3 (GS-N3) | SEQ ID No 56 (GS-P3) Angioblastine | SEQ ID No 105 (242 bp) | SEQ ID No 151 (GS-V3) | 2A | 2C |

TABLE III-continued

| | Genes Name SEQ. ID | Proteins SEQ. ID | Antisense sequences | Vector with antisense inserted | Fig. | Control Fig. |
|---|---|---|---|---|---|---|
| 4 | SEQ ID No 4 (GS-N4) | SEQ ID No 57 (GS-P4) Angioreceptine | SEQ ID No 106 (211 bp) | SEQ ID No 152 (GS-V4) | 1C | 1F |
| 5 | SEQ ID No 5 (GS-N5) | SEQ ID No 58 (GS-P5) Angiodensine | SEQ ID No 107 (191 bp) | SEQ ID No 153 (GS-V5) | 1D | 1F |
| 6 | SEQ ID No 6 (GS-N6) | SEQ ID No 59 (GS-P6) Vassoserpentine | SEQ ID No 108 (238 bp) | SEQ ID No 154 (GS-V6) | 3A | 3D |
| 7 | SEQ ID No 7 (GS-N7) | SEQ ID No 60 (GS-P7) Angiosulfatine | SEQ ID No 109 (205 bp) | SEQ ID No 155 (GS-V7) | 4A | 4F |
| 8 | SEQ ID No 8 (GS-N8) | SEQ ID No 61 (GS-P8) Vassoreceptine | SEQ ID No 110 (186 bp) | SEQ ID No 156 (GS-V8) | 3B | 3D |
| 9 | SEQ ID No 9 (GS-N9) | SEQ ID No 62 (GS-P9) Angiokinasine | SEQ ID No 111 (223 pb) | SEQ ID No 157 (GS-V9) | 4B | 4F |
| 10 | SEQ ID No 10 (GS-N10) | SEQ ID No 63 (GS-P10) Vassosubstratine | SEQ ID No 112 (247 pb) | SEQ ID No 158 (GS-V10) | 3C | 3D |
| 11 | SEQ ID No 11 (GS-N11) | SEQ ID No 64 (GS-P11) Angiosignaline | SEQ ID No 113 (162 pb) | SEQ ID No 159 (GS-V11) | 4C | 4F |
| 12 | SEQ ID No 12 (GS-N12) | SEQ ID No 65 (GS-P12) Angiofoculine | SEQ ID No 114 (166 bp) | SEQ ID No 160 (GS-V12) | 4D | 4F |
| 13 | SEQ ID No 13 (GS-N13) | SEQ ID No 66 (GS-P13) Angiohélicine | SEQ ID No 115 (135 bp) | SEQ ID No 161 (GS-V13) | 2B | 2C |
| 14 | SEQ ID No 14 (GS-N14) | — | SEQ ID No 116 (136 bp) | SEQ ID No 162 (GS-V14) | 4E | 4F |
| 15 | SEQ ID No 15 (GS-N15) | SEQ ID No 67 (GS-P15) Angioacyline | SEQ ID No 117 (152 bp) | SEQ ID No 163 (GS-V15) | 1A | 1F |
| 16 | SEQ ID No 16 (GS-N54) | | SEQ ID No 112 (247 bp) | SEQ ID No 158 (GS-V10) | 3C | 3D |
| 17 | SEQ ID No 17 (GS-N16) | SEQ ID No 68 (GS-P16) PDCL | SEQ ID No 118 (417 bp) | SEQ ID No 164 (GS-V16) | 5A | 5F |
| 18 | SEQ ID No 18 (GS-N17) | SEQ ID No 69 (GS-P17) RPL3 | SEQ ID No 119 (244 bp) | SEQ ID No 165 (GS-V17) | 5B | 5F |
| 19 | SEQ ID No 19 (GS-N18) | SEQ ID No 70 (GS-P18) homol.RNF20 | SEQ ID No 120 (311 bp) | SEQ ID No 166 (GS-V18) | 5C | 5F |
| 20 | SEQ ID No 20 (GS-N19) | SEQ ID No 71 (GS-P19) homol.SFRS4 | SEQ ID No 121 (246 bp) | SEQ ID No 167 (GS-V19) | 5D | 5F |
| 21 | SEQ ID No 21 (GS-N20) | SEQ ID No 72 (GS-P20) CPD | SEQ ID No 122 (203 bp) | SEQ ID No 168 (GS-V20) | 10A | 10F |
| 22 | SEQ ID No 22 (GS-N21) | SEQ ID No 73 (GS-P21) USP9X | SEQ ID No 123 (253 bp) | SEQ ID No 169 (GS-V21) | 5E | 5F |
| 23 | SEQ ID No 23 (GS-N22) | SEQ ID No 74 (GS-P22) NRD1 | SEQ ID No 124 (173 bp) | SEQ ID No 170 (GS-V22) | 6A | 6F |
| 24 | SEQ ID No 24 (GS-N23) | SEQ ID No 75 (GS-P23) Homol. HRX, ALL-1, MLL | SEQ ID No 125 (228 bp) | SEQ ID No 171 (GS-V23) | 10B | 10F |
| 25 | SEQ ID No 25 (GS-N24) | SEQ ID No 76 (GS-P24) ATRX | SEQ ID No 126 (381 bp) | SEQ ID No 172 (GS-V24) | 6B | 6F |
| 26 | SEQ ID No 26 (GS-N25) | SEQ ID No 77 (GS-P25) transp.ac sial.-CMP1 | SEQ ID No 127 (395 bp) | SEQ ID No 173 (GS-V25) | 6C | 6F |
| 27 | SEQ ID No 27 (GS-N26) | SEQ ID No 78 (GS-P26) CBL-b | SEQ ID No 128 (381 bp) | SEQ ID No 174 (GS-V26) | 6D | 6F |
| 28 | SEQ ID No 28 (GS-N27) | SEQ ID No 79 (GS-P27) | SEQ ID No 129 (298 bp) | SEQ ID No 175 (GS-V27) | 6E | 6F |
| 29 | SEQ ID No 29 (GS-N28) | SEQ ID No 80 (GS-P28) CSNK2B | SEQ ID No 130 (413 bp) | SEQ ID No 176 (GS-V28) | 7A | 7F |

TABLE III-continued

| | Genes Name SEQ. ID | Proteins SEQ. ID | Antisense sequences | Vector with antisense inserted | Fig. | Control Fig. |
|---|---|---|---|---|---|---|
| 30 | SEQ ID No 30 (GS-N29) | SEQ ID No 81 (GS-P29) Hémicentine | SEQ ID No 131 (564 bp) | SEQ ID No 177 (GS-V29) | 7B | 7F |
| 31 | SEQ ID No 31 (GS-N30) | SEQ ID No 82 (GS-P30) SYNE-2 | SEQ ID No 132 (414 bp) | SEQ ID No 178 (GS-V30) | 7C | 7F |
| 32 | SEQ ID No 32 (GS-N31) | SEQ ID No 83 (GS-P31) Séladine-1 | SEQ ID No 133 (298 bp) | SEQ ID No 179 (GS-V31) | 7D | 7F |
| 33 | SEQ ID No 33 (GS-N32) | SEQ ID No 84 (GS-P32) CHD2 | SEQ ID No 134 (365 bp) | SEQ ID No 180 (GS-V32) | 7E | 7F |
| 34 | SEQ ID No 34 (GS-N33) | SEQ ID No 85 (GS-P33) BRD2 | SEQ ID No 135 (270 bp) | SEQ ID No 181 (GS-V33) | 8A | 8F |
| 35 | SEQ ID No 35 (GS-N34) | SEQ ID No 86 (GS-P34) Syntaxine 3A | SEQ ID No 136 (298 bp) | SEQ ID No 182 (GS-V34) | 8B | 8F |
| 36 | SEQ ID No 36 GS-N35) | SEQ ID No 87 (GS-P35) SHARP | SEQ ID No 137 (117 bp) | SEQ ID No 183 (GS-V35) | 8C | 8F |
| 37 | SEQ ID No 37 (GS-N36) | SEQ ID No 88 (GS-P36) PLPP | SEQ ID No 138 (96 bp) | SEQ ID No 184 (GS-V36) | 10C | 10F |
| 38 | SEQ ID No 38 (GS-N37) | SEQ ID No 89 (GS-P37) HIP1 | SEQ ID No 139 (393 bp) | SEQ ID No 185 (GS-V37) | 8D | 8F |
| 39 | SEQ ID No 39 (GS-N38) | SEQ ID No 90 (GS-P38) NUP88 | SEQ ID No 140 (100 bp) | SEQ ID No 186 (GS-V38) | 8E | 8F |
| 40 | SEQ ID N° 40 (GS-N39) | SEQ ID N° 91 (GS-P39) FKPB1A | SEQ ID No 141 (90 bp) | SEQ ID No 187 (GS-V39) | 10D | 10F |
| 41 | SEQ ID No 41 (GS-N40) | SEQ ID N° 92 (GS-P40) SALF | SEQ ID No 142 (144 bp) | SEQ ID No 188 (GS-V40) | 9A | 9F |
| 42 | SEQ ID No 42 (GS-N41) | SEQ ID N° 93 (GS-P41) Homol.P29 | SEQ ID No 143 (113 bp) | SEQ ID No 189 (GS-V41) | 10E | 10F |
| 43 | SEQ ID No 43 (GS-N42) | SEQ ID N° 94 (GS-P42) TMEM2 | SEQ ID No 144 (180 bp) | SEQ ID No 190 (GS-V42) | 9B | 9F |
| 44 | SEQ ID No 44 (GS-N43) | SEQ ID N° 95 (GS-P43) Dorfine | SEQ ID No 145 (507 bp) | SEQ ID No 191 (GS-V43) | 9C | 9F |
| 45 | SEQ ID No 45 (GS-N44) | SEQ ID N° 96 (GS-P44) TM4SF2 | SEQ ID No 146 (632 bp) | SEQ ID No 192 (GS-V44) | 9D | 9F |
| 46 | SEQ ID No 46 (GS-N45) | SEQ ID N° 97 (GS-P45) Ecto-ATPase I | SEQ ID No 147 (704 bp) | SEQ ID No 193 (GS-V45) | 9E | 9F |
| 47 | SEQ ID No 47 (GS-N46) | SEQ ID N° 98 (GS-P46) Sélénoprotéine N | SEQ ID No 148 (257 bp) | SEQ ID No 194 (GS-V46) | 11A | 11B |
| 48 | SEQ ID No 48 (GS-N47) | — | SEQ ID No 125 (228 bp) | SEQ ID No 171 (GS-V23) | 10B | 10F |
| 49 | SEQ ID No 49 (GS-N48) | SEQ ID N° 99 (GS-P48) MLL | SEQ ID No 125 (228 bp) | SEQ ID No 171 (GS-V23) | 10B | 10F |
| 50 | SEQ ID No 50 (GS-N49) | SEQ ID N° 100 (GS-P49) ATRX | SEQ ID No 126 (381 bp) | SEQ ID No 172 (GS-V24) | 6B | 6F |
| 51 | SEQ ID No 51 (GS-N51) | — | SEQ ID No 129 (298 bp) | SEQ ID No 175 (GS-V27) | 6E | 6F |
| 52 | SEQ ID No 52 (GS-N52) | SEQ ID N° 101 (GS-P52) Fibuline 6 | SEQ ID No 131 (564 bp) | SEQ ID No 177 (GS-V29) | 7B | 7F |
| 53 | SEQ ID No 53 (GS-N53) | SEQ ID N° 102 (GS-P53) Séladine 1 | SEQ ID No 133 (298 bp) | SEQ ID No 179 (GS-V31) | 7D | 7F |
| 54 | SEQ ID No 225 (GS-N50) | — | SEQ ID No 127 (395 bp) | SEQ ID No 173 (GS-V25) | 6C | 6F |

SEQUENCE LISTING (301 sequences)

SEQ ID NO: 1 - DNA, 1683 bp, Homo sapiens
  GS-N1
  ref <308>: DATABASE ACCESSION NUMBER: GENBANK/BC008502
  ref <309>: DATABASE ENTRY DATE: 2001-07-12
  ref <313>: RELEVANT RESIDUES: (1)..(1683)
agaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatctcagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctcccaaaaaaaaaaaaaaaaaaaaaaaaaaa

SEQ ID NO: 2 - DNA, 1649 bp, Homo sapiens
  GS-N2
  ref <308>: DATABASE ACCESSION NUMBER: GENBANK/NM_022823
  ref <309>: DATABASE ENTRY DATE: 2001-12-10
  ref <313>: RELEVANT RESIDUES: (1)..(1649)
agcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactggaaaaaaaaaaaaaaaaaaa

SEQ ID NO: 3 - DNA, 5766 bp, Homo sapiens
  GS-N3
  ref <308>: DATABASE ACCESSION NUMBER: GENBANK/AB007963
  ref <309>: DATABASE ENTRY DATE: 1998-08-13
  ref <313>: RELEVANT RESIDUES: (1)..(5766)
cgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtgggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggcatccctcaaaggcccaggcgctgccagggggtttgtcctggtagctggaggaaccgatttcagggaatagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttatatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctc

SEQ ID NO: 4 - DNA, 5242 bp, Homo sapiens
  GS-N4
  ref <308>: DATABASE ACCESSION NUMBER: GENBANK/AB037835
  ref <309>: DATABASE ENTRY DATE: 2000-03-14
  ref <313>: RELEVANT RESIDUES: (1)..(5242)
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccatttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagc

SEQ ID NO: 5 - DNA, 2153 bp, Homo sapiens
  GS-N5
  ref <308>: DATABASE ACCESSION NUMBER: GENBANK/AK025682
  ref <309>: DATABASE ENTRY DATE: 2000-09-29
  ref <313>: RELEVANT RESIDUES: (1)..(2153)
caaagagacaaacactgatgaagccgctaatgacaatatggcagttcgccccaaagagcgcagcagcctgagctctagacagcatccgtttgtaaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccaccatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtgggggtattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaaaaaaaa

SEQ ID NO: 6 - DNA, 3005 bp, Homo sapiens
  GS-N6
  ref <308>: DATABASE ACCESSION NUMBER: GENBANK/AK023284
  ref <309>: DATABASE ENTRY DATE: 2000-09-29
  ref <313>: RELEVANT RESIDUES: (1)..(3005)
gacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatatttttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctggactgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcgaaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaattaaaccaatcgtatg

SEQ ID NO: 7 - DNA, 4397 bp, Homo sapiens
  GS-N7
  ref <308>: DATABASE ACCESSION NUMBER: GENBANK/AB033073
  ref <309>: DATABASE ENTRY DATE: 2001-05-17
  ref <313>: RELEVANT RESIDUES: (1)..(4397)
gagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacaagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcgggacgcacttcatcaacgccttcgtgaccacacccatgtgctgcccctcacgctcctccatcctcaccggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttctttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggattt

SEQ ID NO: 8 - DNA, 5844 bp, Homo sapiens
  GS-N8
  ref <308>: DATABASE ACCESSION NUMBER: GENBANK/AB023187
  ref <309>: DATABASE ENTRY DATE: 2001-05-17
  ref <313>: RELEVANT RESIDUES: (1)..(5844)
gttctctgctgctactgtaaaaacgaaatgagtggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgtttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtatataaatcttcaacatgagaggatgtatatttattatataaagcccagtaaagaataaaattagaagttttatcctagg

SEQ ID NO: 9 - DNA, 4266 bp, Homo sapiens
  GS-N9
  ref <308>: DATABASE ACCESSION NUMBER: GENBANK/AB014587
  ref <309>: DATABASE ENTRY DATE: 1999-02-06
  ref <313>: RELEVANT RESIDUES: (1)..(4266)
caagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttct

SEQ ID NO: 10 - DNA, 2034 bp, Homo sapiens
  GS-N10
  ref <308>: DATABASE ACCESSION NUMBER: GENBANK/XM_035658
  ref <309>: DATABASE ENTRY DATE: 2001-12-10
  ref <313>: RELEVANT RESIDUES: (1)..(2034)
ccctggtttcccagtgctggaatatagaaaatggatggacaagtaaatcccactcagcacccatagtccaggcatggggacctcaacacacctgagccccagacatcacctttcattctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacagctggatctaccatgaaagacttgtgaatccaggaagagagactgactgggcaacatgttattcagggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgccccctgattctacattatgctcctacctcccggcagcctctccaggcccagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcaggcccagcatctgcctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacgcccaactcctgtcccaggacatcatctccgggcccaaaacttactcaagtcagactctctagtcccaactgctgcctcctggtggcctatgaaggcccaaaatctcctcaatttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatcaacaggcccagctttgacttgagaacagcctctgcaggccctgctcttgcctctcaggggctttttccaggcccagctcttgcctcatggcagctgccccaggccaaatttctgcctgcctgccagcagcctcaacaggcacagctcctccctcacagtggcccatttaggcccaactcatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggcgaagctcctgcctttcggcagcctctccaggcccagctcctcctgcctcccagtggcctctttcggcccagc

SEQ ID NO: 11 - DNA, 1817 bp, Homo sapiens
  GS-N11
  ref <308>: DATABASE ACCESSION NUMBER: GENBANK/NM_032181
  ref <309>: DATABASE ENTRY DATE: 2001-12-10
  ref <313>: RELEVANT RESIDUES: (1)..(1817)
agcataacctgtttgtgaaactgcaaaaaggttgacatggctgaagcagaagatgggttggtactgaatggttgggagagatatgtagcggctgaccctgaaggacgttgcagcccatgctatggagacctgattttattttgtaagaggtgggcaacccctgaagcattttagtgatgcgaacagatgtgtctgttaccaagcaaagccagttaaagaaggtcacagaggaggaatgatcacaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgtttttttttttttttttttaattggatttcaaagaaaagaatggaaatgagaggtaaggattaaagccaaagttaggatgggaattaaaaaaataaacattacataaaatctt

SEQ ID NO: 12 - DNA, 4131 bp, Homo sapiens
  GS-N12
  ref <308>: DATABASE ACCESSION NUMBER: GENBANK/AB023233
  ref <309>: DATABASE ENTRY DATE: 1999-06-16
  ref <313>: RELEVANT RESIDUES: (1)..(4131)
cttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcatgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatcttcccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataacgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctccagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtgacggattcgactctattcattttcaaataaagccatgagccgtggaacattcttggtcctggtgcttgggttatgatggcaggagtcaagaagaagattactttcattctagaagaatgtagtttctctaattatttgaaatgttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgatt

SEQ ID NO: 13 - DNA, 2566 bp, Homo sapiens
  GS-N13
  ref <308>: DATABASE ACCESSION NUMBER: GENBANK/XM_018273
  ref <309>: DATABASE ENTRY DATE: 2001-10-16
  ref <313>: RELEVANT RESIDUES: (1)..(2566)
tgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactctgactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagtgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtattt

SEQ ID NO: 14 - DNA, 1830 bp, Homo sapiens
  GS-N14
  ref <308>: DATABASE ACCESSION NUMBER: GENBANK/AK055109
  ref <309>: DATABASE ENTRY DATE: 2001-10-31
  ref <313>: RELEVANT RESIDUES: (1)..(1830)
attaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgct

SEQ ID NO: 15 - DNA, 6253 bp, Homo sapiens
  GS-N15
  ref <308>: DATABASE ACCESSION NUMBER: Genbank/NM_014873
  ref <309>: DATABASE ENTRY DATE: 2000-11-02
  ref <313>: RELEVANT RESIDUES: (1)..(6253)
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacattgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttctttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttgggtactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttttgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctgggtagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttc

SEQ ID NO: 16 - DNA, 4749 bp, Homo sapiens
  GS-N54
  ref <308>: DATABASE ACCESSION NUMBER: GENBANK/AK024248
  ref <309>: DATABASE ENTRY DATE: 2000-09-29
  ref <313>: RELEVANT RESIDUES: (1)..(4749)
gcgggtgttcggctacgtcactggggcgctacggttcctggagctgggcagtcttctcgtcagagtggggactggtaagagcgacctccccgccaggtcctgtgtgttgccggctgaagaagggatgatgattattccccaccttctaagagacaaagaccaacgagccaccacagccaccagtcccagaacccgccaatgctggggaatggaaaatgagggagttcaactctggccctcacaatccagtggaggagacgaaactcatctgcctctgtccctctgggcacacctcatgccaggtgcatctgtggacaggggccatgctcctgggcttccaaagttggagaaagctgccaggctcagacccacctaagctgaagattcccttgagaacaagtactgtcctgtggtttcatggcctttcttccatttgtggttcttgcgaagtggaatttaaatgacatcttatcaagatggataaaccctggtttcccagtgctggaatatagaaaatggatggacaagtaaatcccactcagtacccataggccaggcatggggacctcaacacacctgagccccagacatcacctttcattctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacagctggatctaccatgaaagacttctgaatccaggaagagagactgactgggcaacatgttattcagggtctccctctgttgtccaaggctggagtgtagtagtgctatcacagctgactgcagcctcaaccttccaggctgaagtgattctcccatctcaacctcccacgtggctgagactacaggtgcttgccaccatgcccaactaatatttggaattttcatataagtggattccagaggggtgacagcaaaacgtgggaccatccagttgcaggaaaacaagcttaacacgcccactgattttacattatgctcctaccacccggcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcattacaatggcctctttagacccagctcctgcctcccagccttctctccaggccctgaactttctgaagtcgacctcaccaggcccagctcatgcttctttgcagcctctccaggcccagctcctgcatcttggtggcccctccaggcccagcctctgcctcccgtcggcctctacagtcccaacatctgcctcatagcagattcttgaggcccagcatctgcctcactgtggaccccccaagccaagctcccaacctttcagcagcttctacacacccagctcctgccacccagtggcctctttaggccaagctcatgcttcacaagggcctttccaggcccaactttcgtctcatggcaaccttccctggccagattcctgcgtgtctcccagcagcctagacaggcccaggtcttgcctcacactggcctctctacatccagctcatgcctcacggtgacctctccaggcacagctcctgtcccagaacgtcatctccgggcccaaaacttactcgagtcagcctctctagtcccaactgctgcctcctggtggcctatgaaggcccaaaatctcctcaagttgacctctcccggcccagctcctgcctcctgtcagcatctacaggcccaacctctgcctcatgggggcttctccgggcccagctcttcctattggctgagtctacaggcacaactgctgcctcacaacagccttttttggcccagttcctgtccagttcatggcggccaatgtaggcccaaaacttcctcaggtcatactctccaggcccaccttctgcttcctggtggcatgaacaggcccagctttgacttgagaacagcctctgcaggccctgcacttgcctcccaggggcttttccaagcccagctcttgcctcatggcagctgccccaggccaaatttcttcctgcctgccagcagcctcaacaggcacagctcctccctcacagtggcccatttaggccccactcatgactgtcgggccatttccaggcctagtgcctgcctcctggctgactctttcttgaagcccaaaacttcctcaaatcagccttttgcctaacttctgtctactgtcggactctacaggccagcctctgcctcacagtggaccctccagacccagatggtgtctcactgtggcatcctcaggcgaagctcctgcctttcggcagcctctacaggcccagctcctgccttgcagtggcctctttaggccaagctcatgccgcatggcgacttttccaggcacagcttttgccttttgcagcctgtccaggcccagaatgtccttaactcggcatctccaggacgagcttatcctcccagtgcgtctacaggcccgtctcctgcctcacaacaacctcttttggcccaactcctgctgagctgctggcagcctctgtaggccacagacttcttaaagtaaagctttccagccaccttcggcctcccagcagcctcagcaatcaaactattccctcactgcggccaccgaaagccaagtttctccctgcctcatggcatcctccgaaaactgagcatttgcctcacggtggcctccccaggccacgaatctgcctgcctcccaggcaggtgctgcctcacaatggtctctttaggcccagctcatgctaaaagatggactctccaggtacagctcttgcctcctggcagcctctgcaggcccaaattctccaaaagttggcctctcctaactcagctcctgcctcatgtcggcctacacaggcccagactcttaccacacagtagaccctccaggcccaccacttgcctgatcatagcctcctaaggccaagctcctgcctttcagcagcctctacaggcccagctcctgcctcgcaattgcctttgtaggccaagatcatgccgcgaagtggcctttcctagcctaacttttgctttttgacgcatactccagtcccaaaacttcctccagtcagccggtccaggccaagctcttcctcccaaaggcttctgcaggccaaaatcatcctgaagtcaccctctgcaggcccagctcctgcctccaagtgctgtgtaggccaagctaatgcctcacagcacactttccaggctgagcgtttccttttgtgcatcctctccaagccctgaacttactccacttggcctctccagaccaagctctccctcccagtggcctctacaggccaaaattgtcctcaggtctgcctctccagggccacctcttagctaccagtggcttctgctggccaaaatcgacctcaagtcagcctcttcacacccagctcttgcctctgagtggcctctccaggagcaaaactttctcaagtcggcctctccaggcccagcctcctgcttcccgagggcatgtacaggcccagcctctgcctcacagcagactctccacacccagctcatccctgtctgcggcctctccagtccaaagctgctgctgccttttggcagcttgtacaggctcagctcctccctcacggtggcctctttcagcccaactcatgcctcttgcaacctgcccaagtgtcagctcctgtctcacactggcctgttgagggccagctcatgcctctcgtggcctcaacaggcccatcccctgcctgtcggcggcctctacaggcccggcctctacctcacagtgggctctccaggcccacctcttcctcaccgtggcctcctggggcaatgctcctccctctcgggagcctctgcgggcccagctcctgcctcccagtggcctctgtagaccaagcccgtgcctcagggcagcctttccaggcctagcgtttgctgctttgcatcctctccaggccctggacttcctccagtcggcctctccaggcccagctcttcctctcggcggcctctgcagggccagactgtcgtcaagtcggcctgtccagggccagctcctgcctcccggcggcctctgcaggcccaagtcgttctcaagtcggcttccccaggcccagctccggcctcttggcggcctctccgggtgcaaaagttcctcgagtcagcctctccaggcccagctcctcctgcctcccagtggcctctttcggcccagcccagctcttcctcccggctgcgtctccaggcccgactttggcctcccaacaacgtctttggactcagctcctgcctctcaaaggcctgcacgggcccggcctcggcctcggcctcacagcggactctccacgcccagctagctctcgcctcactgtggcctccccagtccaaagctcctgcctttcggccacttcagcaggtccagctcctgcctgccagtggcctctttaggcccagctcattcctcacaacggccttcccaggccccgtttttcccttccggcagcctcttggcctctaatttgtttatcttttgtgtataaatcccaaaatatggaattttggaatatttccaccatt

SEQ ID NO: 17 - DNA, 3139 bp, Homo sapiens
  GS-N16
  ref <308>: DATABASE ACCESSION NUMBER: GENBANK/XM_011833
  ref <309>: DATABASE ENTRY DATE: 2002-12-10
  ref <313>: RELEVANT RESIDUES: (1)..(3139)
cgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataatatttcatcatttggatatataataatttatttaaccagtctctttatttttatttatttattttgtttgttttctttgagatggagtctcgctctgtcacccaggctggagtacaatagcgtgatctcggctcactgcaacctccacctcctgggttcaagcagttctcctgcctcagcctcctgagtagctgggcacggtgttgtacctctagtcccagctacttgggaggcttagtcaggaggatctcttgagcctgggaggtcaaggctgcagtgaaccatgattgcactccaacctgggcgacagagaccctgtctcaaaaaa

SEQ ID NO: 18 - DNA, 2326 bp, Homo sapiens
  GS-N17
  ref <308>: DATABASE ACCESSION NUMBER: GENBANK/BC011860
  ref <309>: DATABASE ENTRY DATE: 2001-08-29
  ref <313>: RELEVANT RESIDUES: (1)..(2326)
ggcacgaggggagtccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctaaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaataaaaaaaaaaaaaaaaaaaaaaaaaaaaaaaaaaaaaaaaaaaaaaaaaaaaaaaaaaaaaaaaaaaaaaaactcgagactagttctctggcgtgatgtctcacagaaagttctccgctcccagacatgggtccctcggcttcctgcctcggaagcgcagcagcaggcatcgtgggaaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaaaaaaaaaaaaaaaaaaaaa

SEQ ID NO: 19 - DNA, 3937 bp, Homo sapiens
  GS-N18
  ref <308>: DATABASE ACCESSION NUMBER: GENBANK/XM_042798
  ref <309>: DATABASE ENTRY DATE: 2001-10-16
  ref <313>: RELEVANT RESIDUES: (1)..(3937)
aagttctgccttgtctccgccgcgggtcaggggtgagagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctcttatcccggaagctaaacagtggagataatctgatagtggaggaagcagtgcaggagctgaactctttcctcgcacaggagaatatgaggctacaggaattgacagatcttcttcaggaaaagcatcgcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaagactttgaggaggtcactacacaaaatgaaaagctgaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgagcgagatgaggttagtcttcataagaagctgaggactgaagtaattcagctagaagatacattggcccaggtccgcaaggagtatgaaatgctgaggatagaatttgagcagacccttgctgccaatgaacaagcaggccctataaacagggagatgcgccacctcatcagtagcctccagaatcacaatcaccagctgaaaggggaggtcctgagatataagcggaaattgagagaagcccagtctgacctgaacaagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggttgatgcccagctacaggtagtaaggaaactggaagagaaggagcatctgttacagagcaacattggcacaggggagaaagagctgggtcttaggacccaagccttagagatgaataaacgcaaggcaatggaggcagcccagcttgcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacaaagaaaccagacaatgtacccaagtgtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaagccttgggtttcagaatgaattagaaacaaataactcttactgtcttccctcccagctttgtttattttgtgcttttagacttttcagtgttttctttttccagcccactgtataaacttggattgtccattcctcctgaagaaatcaagttggtatttttgatgtggaaaagggaacaaaagtggaaacatggctacttttggggagtgatattttaaaaaataagttgtctatgggcacaaagttttcttcatttgtgtagcaaacttcttgtgaatgtggattacaaaatggtataattgtgctactctcccctgggtggtttgcagccctaatgaaattatgtctaggatgattcagtctatttcccatttactagcagagtaacttgttaagatcagctggctttcttgttaaagttatttaagttttgaatgctctactacttcaagtctttaaatttcttgagactagaataattttaaataatatgaccctttgtcttctaatgaaataaagattgaagaggttgagtcaggactgagctggtgaagaaatcttgtgggtattctggaaatttgatacggagagaacttggtgagctatgaattactctcagtctcctttttacagggttgttgtgatccctcttttccagaaaattctgtggaatgtttctgtaggactttgttctccacaagcttgaattaaagcaggattcagtttgc

SEQ ID NO: 20 - DNA, 2167 bp, Homo sapiens
  GS-N19
  ref <308>: DATABASE ACCESSION NUMBER: GENBANK/BC002781
  ref <309>: DATABASE ENTRY DATE: 2001-07-12
  ref <313>: RELEVANT RESIDUES: (1)..(2167)
ggcacgaggccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaaaaaaaaaaaaaaa

SEQ ID NO: 21 - DNA, 5801 bp, Homo sapiens
  GS-N20
  ref <308>: DATABASE ACCESSION NUMBER: GENBANK/U65090
  ref <309>: DATABASE ENTRY DATE: 1997-10-02
  ref <313>: RELEVANT RESIDUES: (1)..(5801)
gaattcgcggccgcgtcgaccggcgctgctggaagatggcgagcggccgggacgagcggccgcattgcgtagggcggctcctgttgctcatgtgcctgctgctgctggggagctcggcccgggcggctcacatcaagaaggcggaggcgactaccacaactacgagcgcgggcgcgaggggccgagggcagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggcgctaccgcccggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctgccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacagaactttagtctttctgttgccttagatggtggttccatgctggtcacatatccatatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaaaaaaaaaaaaaaaaaaaaaaaaaaaa

SEQ ID NO: 22 - DNA, 8171 bp, Homo sapiens
  GS-N21
  ref <308>: DATABASE ACCESSION NUMBER: GENBANK/NM_004652
  ref <309>: DATABASE ENTRY DATE: 2001-02-03
cttttctcaagacaactacataagcagacaaaattgcaaagatctgccctgtgtcgagtatgacagccacgactcgtggctctccggtcggagggaatgacaaccagggccaggctcctgatggacagtctctgccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgtaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttttcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacctttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatccctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaa

SEQ ID NO: 23 - DNA, 3851 bp, Homo sapiens
  GS-N22
  ref <308>: DATABASE ACCESSION NUMBER: GENBANK/NM_002525
  ref <309>: DATABASE ENTRY DATE: 2000-10-31
  ref <313>: RELEVANT RESIDUES: (1)..(3851)
agactggggtgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggacgtcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcctacaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttctgtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggcagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggctcatagagggccaggaagtaaaatgctcagcgttcatgttgttgggtatgggaagtatgaactggaagaggatggatccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaaaaaaaaaaaaaaaaaaaaaaaaaaaaaaaa

SEQ ID NO: 24 - DNA, 13107 bp, Homo sapiens
  GS-N23
  ref <308>: DATABASE ACCESSION NUMBER: GENBANK/XM_016303
  ref <309>: DATABASE ENTRY DATE: 2001-10-16
  ref <313>: RELEVANT RESIDUES: (1)..(13107)
ccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggacccccggattaaacatgtctgcagaagagcagctgttgcccttggcccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcaggtacagaagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcagggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtctcatatctgcagagaacccagtgatcacattgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcc

SEQ ID NO: 25 - DNA, 10330 bp, Homo sapiens
  GS-N24
  ref <308>: DATABASE ACCESSION NUMBER: GENBANK/U72937
  ref <309>: DATABASE ENTRY DATE: 2000-02-11
  ref <313>: RELEVANT RESIDUES: (1)..(10330)
ctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttctttaggaatcaatgacttaacagaactcaactgtataaatagtttggtccccttaaatgccaatcttccatattagttttacttttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaatttaggcaaccttctaaatcttttcaccatggatgaaactataacttaaagataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 26 - DNA, 1777 bp, Homo sapiens
  GS-N25
  ref <308>: DATABASE ACCESSION NUMBER: GENBANK/NM_006416
  ref <309>: DATABASE ENTRY DATE: 2001-12-10
  ref <313>: RELEVANT RESIDUES: (1)..(1777)
agttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaacgacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaatcggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctc

SEQ ID NO: 27 - DNA, 3982 bp, Homo sapiens
  GS-N26
  ref <308>: DATABASE ACCESSION NUMBER: GENBANK/U26710
  ref <309>: DATABASE ENTRY DATE: 1996-09-30
  ref <313>: RELEVANT RESIDUES: (1)..(3982)
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctagcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacaggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcctgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacaatttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaagtatgtattcttcactactgagtttcttctttggaaaccatcactattgagagatgggaaaaacctgaatgtataaagcatttatttgtcaataaactgccttttgtaaggggttttcacataaaaaaaaaaaaa

SEQ ID NO: 28 - DNA, 3385 bp, Homo sapiens
  GS-N27
  ref <308>: DATABASE ACCESSION NUMBER: GENBANK/XM_039529
  ref <309>: DATABASE ENTRY DATE: 2001-10-16
  ref <313>: RELEVANT RESIDUES: (1)..(3385)
gtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtgagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcgcttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcctattcctatccccagtaaaaataggcctttccacaatcttctaccagttaacttagctttttttttttttttttcctttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagaaagcaccttgaggcacagatgagaagcttggccttacctgatgccttgattttagcctggtgagaccctgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggtgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcacgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgt

SEQ ID NO: 29 - DNA, 1128 bp, Homo sapiens
  GS-N28
  ref <308>: DATABASE ACCESSION NUMBER: GENBANK/NM_001320
  ref <309>: DATABASE ENTRY DATE: 2000-10-31
  ref <313>: RELEVANT RESIDUES: (1)..(1128)
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggcc

SEQ ID NO: 30 - DNA, 18207 bp, Homo sapiens
  GS-N29
  ref <308>: DATABASE ACCESSION NUMBER: GENBANK/AF156100
  ref <309>: DATABASE ENTRY DATE: 2001-06-29
  ref <313>: RELEVANT RESIDUES: (1)..(18207)
gaagccgcatccagacaaaagctgccgcatccctgccctgcccaacccctggagggattcgagtttggtgcttgtccccgtctgattctcagcgccaaactttttgctagttcagagattccaagagtctgatgagttactctgagaggaaaccctctgcctgttgttgaggaggactgagcacagtgcttaggcgctgagggggaaaaagaaggggaaaaaaaagaaaatgatttcctgggaagttgtccatacagtattcctgtttgctcttctttattcttccctagctcaagatgcgagcccccagtcagagatcagagctgaggaatttcccgagggggcctccacgttggcttttgtgtttgatgtgactggttctatgtatgatgatttagttcaggtgattgaaggggcttccaaaattttggagacgtctttgaaaagacctaaaagacctcttttcaactttgcgttggtgcctttccatgatccagaaattggcccagtgacaattaccacagatcccaagaaatttcaatatgaactcagagaactgtatgttcagggtggtggtgattgcccagaaatgagtattggagctataaaaattgccttggaaatttctcttcctggttctttcatctatgttttcactgatgctcggtccaaagattaccggctcacccatgaggtgctgcaacttatccaacagaaacagtcacaagtcgtatttgttctgactggagattgtgatgacaggacccatattggatataaagtctatgaagaaattgcctctacaagttctggtcaagtgttccatctggacaaaaaacaagttaatgaggtattaaaatgggtagaagaagcagtacaggcctccaaagttcaccttttatccacagatcatttggaacaggctgtaaatacttggagaattccttttgatcccagcctgaaagaggtcactgtgtctttgagtgggccttctccaatgattgaaattcgcaatcctttagggaagctgataaaaaagggatttggcctgcatgagctattaaatatccataactctgccaaagtagtgaatgtgaaagagccagaggctggaatgtggacagtgaagacctcaagcagtggaaggcactctgttcgcattactggcctcagtactattgatttccgagctggcttttctcgaaagcccaccctggacttcaaaaaaacagtcagcagaccagtgcaaggaatacctacctatgtactgctcaatacttctggaatttccactccagctagaatagatcttcttgaacttttgagtatctcaggaagttctcttaagactattcctgttaaatattacccacatcgaaaaccttatggcatatggaatatttctgactttgtaccaccaaatgaagctttctttctcaaagtaacaggctatgataaagatgattacctcttccagagagtatcaagtgtttccttttctagtattgtcccagatgctcccaaagttacgatgcctgagaaaaccccaggatactatctgcagccgggccaaattccctgctctgttgacagtcttttgccctttaccttgagctttgtcagaaatggagttacacttggagtagaccagtatttgaaagaatctgccagtgtgagcttagatattgcaaaggtcactttgtctgacgaaggtttctatgaatgcattgctgtcagcagtgcaggtactggacgggcacagacattttttgacgtatcagagccccctccggtcatccaagtgcctaacaatgttacagtcactcctggagagagagcagttttaacatgtctcatcatcagtgcggtggattacaatctaacctggcagaggaatgacagagatgtcagactggcagagccagcgagaattaggaccttggctaatctgtcattggagctaaagagtgtgaaattcaacgatgctggagagtatcattgtatggtttctagtgaaggtggatcatcagccgcttcagttttcctcacagtgcaagaaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcacacaggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatttggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctgaaggagaggagagtggggagtatgtctgcactgccaccaatacagccggctacgccaaaaggaaagtgcagctaacagtctatgtaaggcccagagtgtttggagatctacgaggactgtcccaagataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtccaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagaaggcacattgctggttattgcttctgttacaccctatgacaatggggagtacatctgtgtggcagtcaatgaagctggaaccacagaaagaaaatataacctcaaagtccatgttcctccagtaattaaagataaagaacaagtatcaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctagttccacccaccataataggtaccaacttcccaaaggaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaatgcacggagaaatgacaaggggcgctaccaatgtactgtgtctaatgcagctggcaaacaagccaaggatataaaactgactatctatattccacctagtattaaaggaggaaatgtcaccacagacatatcagtattgatcaacagccttattaaactggaatgtaaaacacggggacttccaatgcctgccattacttggtataaggacgggcagccaatcatgtccagctcacaagcactttatattgataaaggacaatatcttcatattcctcgagcacaggtctctgattcagcaacatatacgtgtcacgtagccaatgttgctggaactgctgaaaaatcattccatgtggatgtctatgttcctccaatgattgaaggcaacttggccacgcctttgaataagcaagtagttattgctcattctctgacactggagtgcaatgctgctggaaacccttctcccattctcacctggttgaaagatggtgtacctgtgaaagctaatgacaatttccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacaggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataattgtttactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtacacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatgctcctccaagcatcataggaaaccacaggtcacctgaaaatattagtgtggtagaaaagaactcagtatctttgacttgtgaagcttctggaattcccctgccttccacaacctggttcaaagatgggtggcctgtcagccttagcaattctgtgaggattctttcaggaggcaggatgctacggctgatgcagaccacaatggaagatgctggccaatatacttgtgttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacattccacccataatcaataaaggggacctttgggggccaggtctttcccctaaagaagtgaagatcaaagtaaacaacactctgaccttggaatgtgaagcgtatgcaattccttctgcctccctcagctggtacaaggatggacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcgagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgamcagcccatcaaactgaacacaaatactctcattgtgcctggtggtcgaactctacagattattcgggccaaggtatcagatggtggtgaatacacttgtatagctatcaatcragctggcgaaagcaagaaraagttttccctgactgtttatgtgccmccmagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaactacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgacttatgtggatacttcaataaatattgaatgcagagycacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtgccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaatagcatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaactggatttgtttatgtgaaagaacctccagtcttcaaaggtgattatccttctaactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccaattcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtgaaaagactcggaagcggctgtgcgaccatcctgtgccagttaaaggtggccgtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaaggagatcgcagtaatcagtgcccctccgggtttaccttagactcagttggacctttttgtgctgatgaggatgaatgtgcagcagggaatccctgctcccatagctgccacaatgccatggggacttactactgctcctgccctaaaggcctcaccatagctgcagatggaagaacttgtcaagatattgatgagtgtgctttgggtaggcatacctgccacgctggtcaggactgtgacaatacgattggatcttatcgctgtgtggtccgttgtggaagtggctttcgaagaacctctgatgggctgagttgtcaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaagcagctatcgttgtgtatgcccaagaggttatcggtctcaaggagttggaagaccctgcatggacattgatgaatgtgaacaagtgcctaaaccttgtgcacatcagtgctccaacacccccggcagcttcaagtgtatctgtccaccaggacaacatttattaggggacgggaaatcttgcgctggattggagaggctgccaaattatggcactcaatacagtagctataaccttgcacggttctcccctgtgagaaacaactatcaacctcaacagcattacagacagtactcacatctctacagctcctactcagagtatagaaacagcagaacatctctctccaggactagaaggactattaggaaaacttgccctgaaggctctgaggcaagccatgacacatgtgtagatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgarartggtgctacactctgttttgtgtgccttccttggtacttctgaggtattttcatgatcccaccatggtcatatcttgaagtatggtctagaaaagtcccttattatttattattacactggagcagttacttcccaaagattattctgaacatctaacaggacatatcagtgatggttacagtagkgtagtacctaagatcattttcctgaaagcccaaccaracaacgaraaacaagaacaactaattcagaatcaaatagagtttttgagcatttgactatttttagaatcataaaattagttacawagtattttgatcaaagcctattaaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacaggtttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcat

SEQ ID NO: 31 - DNA, 4325 bp, Homo sapiens
  GS-N30
  ref <308>: DATABASE ACCESSION NUMBER: GENBANK/NM_015180
  ref <309>: DATABASE ENTRY DATE: 2001-07-15
  ref <313>: RELEVANT RESIDUES: (1)..(4325)
ggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacacagcacgggctccctggagcccagggcagctttcagattgtgttcctccccaggagcagggaacctgtgtggcaggtgccccgggtactttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagaaaaaaaaaaaaaaaaaa

SEQ ID NO: 32 - DNA, 4248 bp, Homo sapiens
  GS-N31
  ref <308>: DATABASE ACCESSION NUMBER: GENBANK/AF261758
  ref <309>: DATABASE ENTRY DATE: 2000-10-10
  ref <313>: RELEVANT RESIDUES: (1)..(4248)
cccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggccagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaagcctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctgg

SEQ ID NO: 33 - DNA, 7764 bp, Homo sapiens
  GS-N32
  ref <308>: DATABASE ACCESSION NUMBER: GENBANK/NM_001271
  ref <309>: DATABASE ENTRY DATE: 2000-10-31
  ref <313>: RELEVANT RESIDUES: (1)..(7764)
ccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcttagcacgtgatgctgagctggtagataagtcggtggcagatctgaagcgcctgggtgaactgatccacaacagctgtgtgtcagcaatgcaggaatatgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaggaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttgg

SEQ ID NO: 34 - DNA, 4693 bp, Homo sapiens
  GS-N33
  ref <308>: DATABASE ACCESSION NUMBER: GENBANK/XM_042555
  ref <309>: DATABASE ENTRY DATE: 2001-10-16
  ref <313>: RELEVANT RESIDUES: (1)..(4693)
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtacgcgcgcggccccgatgctctccccacccccccagcccgttcgggaagggaggggctgggggctacgccccatcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatatt

SEQ ID NO: 35 - DNA, 2983 bp, Homo sapiens
  GS-N34
  ref <308>: DATABASE ACCESSION NUMBER: GENBANK/BC007429
  ref <309>: DATABASE ENTRY DATE: 2001-07-12
  ref <313>: RELEVANT RESIDUES: (1)..(2983)
ggcacgagggcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaaaaaaaaaaaaaaaaaaaaaaaaaaaaaaaaaa

SEQ ID NO: 36 - DNA, 12227 bp, Homo sapiens
  GS-N35
  ref <308>: DATABASE ACCESSION NUMBER: GENBANK/NM_015001
  ref <309>: DATABASE ENTRY DATE: 2001-07-12
  ref <313>: RELEVANT RESIDUES: (1)..(12227)
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccaaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacac

SEQ ID NO: 37 - DNA, 5376 bp, Homo sapiens
  GS-N36
  ref <308>: DATABASE ACCESSION NUMBER: GENBANK/AF352051
  ref <309>: DATABASE ENTRY DATE: 2001-09-20
  ref <313>: RELEVANT RESIDUES: (1)..(5376)
ggcacgaggaaacctctaggtccaccacctccatcttacacgtgtttccgttgtggtaaacctggacattatattaagaattgcccaacaaatggggataaaaactttgaatctggtcctaggattaaaaagagcactggaattcccagaagttttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctgggtcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcgaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacatccctgttatgtcactttttgattacaataaaagttttcagtaaacttttcaaaaaaaaaaaaaaaaaaa

SEQ ID NO: 38 - DNA, 6626 bp, Homo sapiens
  GS-N37
  ref <308>: DATABASE ACCESSION NUMBER: GENBANK/NM_005338
  ref <309>: DATABASE ENTRY DATE: 2001-01-26
  ref <313>: RELEVANT RESIDUES: (1)..(6626)
cagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttcccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgttttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccactttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaagctcatctttctgcccggctacatcagccttcaagaatcagaagaaagccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttgggaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggttaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagacccgtgctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatc

SEQ ID NO: 39 - DNA, 2366 bp, Homo sapiens
  GS-N38
  ref <308>: DATABASE ACCESSION NUMBER: GENBANK/BC000335
  ref <309>: DATABASE ENTRY DATE: 2001-07-12
  ref <313>: RELEVANT RESIDUES: (1)..(2366)
ggcacgaggagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacaaaaaaaaaaaaaaaaaaaaaaa

SEQ ID NO: 40 - DNA, 1543 bp, Homo sapiens
  GS-N39
  ref <308>: DATABASE ACCESSION NUMBER: GENBANK/XM_049486
  ref <309>: DATABASE ENTRY DATE: 2001-10-16
  ref <313>: RELEVANT RESIDUES: (1)..(1543)
aggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctca

SEQ ID NO: 41 - DNA, 3824 bp, Homo sapiens
  GS-N40
  ref <308>: DATABASE ACCESSION NUMBER: GENBANK/XM_042827
  ref <309>: DATABASE ENTRY DATE: 2001-10-16
  ref <313>: RELEVANT RESIDUES: (1)..(3824)
ggactttgggactggacagacctggtcacagtctaggttctacatcttactggtcgagcaactttagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 42 - DNA, 1365 bp, Homo sapiens
  GS-N41
  ref <308>: DATABASE ACCESSION NUMBER: GENBANK/BC010862
  ref <309>: DATABASE ENTRY DATE: 2001-07-17
  ref <313>: RELEVANT RESIDUES: (1)..(1365)
ggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttctaaaaaaaaaaaaaaaaaaaaaa

SEQ ID NO: 43 - DNA, 6147 bp, Homo sapiens
  GS-N42
  ref <308>: DATABASE ACCESSION NUMBER: GENBANK/NM_013390
  ref <309>: DATABASE ENTRY DATE: 2000-11-02
  ref <313>: RELEVANT RESIDUES: (1)..(6147)
gcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccatggggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaacatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttccaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttttgtatattgatgaatgagatcttacctattaaatatattattggaaaaaaaaaaaaaaaaaaaattaaagtttgagtgtgtgtgtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtatttt

SEQ ID NO: 44 - DNA, 4357 bp, Homo sapiens
  GS-N43
  ref <308>: DATABASE ACCESSION NUMBER: GENBANK/AB029316
  ref <309>: DATABASE ENTRY DATE: 2001-03-14
  ref <313>: RELEVANT RESIDUES: (1)..(4357)
atagtcaccagaagctggaagagtcaaaggacacattctcccctcaagccccagtgggagcacggcccagctggattttggacttctggcctccagaactagacagggcctcacggtgtcacccagggtggaatacagtggtgtgatcatagctcactgcagcctggaattcctgggctcaagcaaccctgccacctcagccttccaagtagctaggactacagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgagcggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagttatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgtactgctgcaaaaaaaaaaaaaaaaaaaaaaaaaaa

SEQ ID NO: 45 - DNA, 1801 bp, Homo sapiens
  GS-N44
  ref <308>: DATABASE ACCESSION NUMBER: GENBANK/XM_032382
  ref <309>: DATABASE ENTRY DATE: 2001-12-10
  ref <313>: RELEVANT RESIDUES: (1)..(1801)
cttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattacaagc

SEQ ID NO: 46 - DNA, 2081 bp, Homo sapiens
  GS-N45
  ref <308>: DATABASE ACCESSION NUMBER: GENBANK/AJ133133
  ref <309>: DATABASE ENTRY DATE: 2000-01-19
  ref <313>: RELEVANT RESIDUES: (1)..(2081)
cccgggtgtacgtgtaaaattatgatcaaataaatttgtatgccttttctcctattaacctgccttttttgtcagcgattgtcagtgaaacttcagagggcaaaggggaagttttccttggcccctccagttttggtgctgtgaacaggataccaaagctgctctgttcttctggaagctgcaatgaagggaaccaaggacctgacaagccagcagaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaaaaaaaaaaaaaaaaaaaaa

SEQ ID NO: 47 - DNA, 4332 bp, Homo sapiens
  GS-N46
  ref <308>: DATABASE ACCESSION NUMBER: GENBANK/AJ306399
  ref <309>: DATABASE ENTRY DATE: 2001-10-15
  ref <313>: RELEVANT RESIDUES: (1)..(4332)
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcttgttctgtcacccagactggagtgcagtggtgcagtcacagctcactgcagcctcaacttccctggctcaattgatcctcctgcctcagcctcctgaggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccgccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaac

SEQ ID NO: 48 - DNA, 14255 bp, Homo sapiens
  GS-N47
  ref <308>: DATABASE ACCESSION NUMBER: GENBANK/L04731
  ref <309>: DATABASE ENTRY DATE: 1993-08-03
  ref <313>: RELEVANT RESIDUES: (1)..(14255)
gcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcaggagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcaggtacagaagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaatgtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcagccaaagccccaaatggagggttggttagattcctgacagtttgccagccagccgccacctacagcgtctgtcgaacaaacagaggtctggtggttttccctactgtcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagattttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcc

SEQ ID NO: 49 - DNA, 11910 bp, Homo sapiens
  modified_base (89)..(89): a, t, c or g
  GS-N48
  ref <308>: DATABASE ACCESSION NUMBER: GENBANK/NM_005933
  ref <309>: DATABASE ENTRY DATE: 2001-12-19
  ref <313>: RELEVANT RESIDUES: (1)..(11910)
atggcgcacagctgtcggtggcgcttccccgcccgacccgggaccaccgggggcggcggcggcggggggcgccggggcctagggggcgncccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatcgtgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaa

SEQ ID NO: 50 - DNA, 10452 bp, Homo sapiens
  GS-N49
  ref <308>: DATABASE ACCESSION NUMBER: GENBANK/U72936
  ref <309>: DATABASE ENTRY DATE: 2000-02-11
  ref <313>: RELEVANT RESIDUES: (1)..(10452)
ctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagtgctgtggtgatatccttatatttgattccttgtgcacatgtgggagaaaatctccaaagaattacctagttttgcttaattcttgagcgatgtatgcaccaaagcacatagaagatacttaaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttctttaggaatcaatgacttaacagaactcaactgtataaatagtttggtccccttaaatgccaatcttccatattagttttacttttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaatttaggcaaccttctaaatcttttcaccatggatgaaactataacttaaagataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 51 - DNA, 4461 bp, Homo sapiens
  GS-N51
  ref <308>: DATABASE ACCESSION NUMBER: GENBANK/AL110212
  ref <309>: DATABASE ENTRY DATE: 2000-02-18
  ref <313>: RELEVANT RESIDUES: (1)..(4461)
gggcttcatgtataatatcttaatatgtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacgacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaacgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagctttttttttttttttccttaatagagtctcattcttgtcacccagactggagtgcgatggcacgatcttggctcactgcaaccctccctcccgggttccagcgattctcctgcctcagcctcccgggtggctgggattgcaggcgcacgccaccatgcccagctaatttttgtatttttagtagacgtggggtttcaccatgttggccagactggtctcaagctcctgacctcgggcgatccgcccgtctaggccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgatgggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgactccactgctttaagcctctgtcttcatccttaaagtggcgatgatagtacgtacctcactctgatctctgaatgagaacacatgtaagacacttagcacagttcctggtgctcaaagagttccaacacctgaaagcaccatggccctgtttgcttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctagttctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaacgacaaaaagcaagctagttgatttgtcaattttgagtttaaatgttttgactgcttatcagcaaaaaaaatcaaagaatagcatactaatattaatggaaatgcagagtatatttaattggcatgattttttcacggatgtgtgcttcatttgatctattgtatgtagctcgtgatcacattttctgttggttaacattgttcctagcttatatgatggaattaaatatattctgtgcaaaaaaaaaaaaaaaaaaaa

SEQ ID NO: 52 - DNA, 8546 bp, Homo sapiens
  GS-N52
  misc_feature (162)..(162): a, t, c or g
  misc_feature (357)..(357): a, t, c or g
  ref <308>: DATABASE ACCESSION NUMBER: GENBANK/AJ306906
  ref <309>: DATABASE ENTRY DATE: 2001-04-26
  ref <313>: RELEVANT RESIDUES: (1)..(8546)
cctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggnggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgngagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtcccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaataacatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaattggatttgtgtatgtgaaagaacctccagtcttcaaaggtgattatccttctcactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccagttcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtgaaaagactcggaagcggctgtgcgaccatcctgtgccagttaaaggtggccgtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaaggagatcgcagtaatcagtgcccctccgggtttaccttagactcagttggacctttttgtgctgatgaggatgaatgtgcagcagggaatccctgctcccatagctgccacaatgccatggggacttactactgctcctgccctaaaggcctcaccatagctgcagatggaagaacttgtcaagatattgatgagtgtgctttgggtaggcatacctgccacgctggtcaggactgtgacaatacgattggatcttatcgctgtgtggtccgttgtggaagtggctttcgaagaacctctgatgggctgagttgtcaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggacattaatgaatgtgaacaagtgcctaaaccttgtgcacatcagtgctccaacacccccggcagcttcaagtgtatctgtccaccaggacaacatttattaggggacgggaaatcttgcgctggattggagaggctgccaaattatggcactcaatacagtagctataaccttgcacggttctcccctgtgagaaacaactatcaacctcaacagcattacagacagtactcacatctctacagctcctactcagagtatagaaacagcagaacatctctctccaggactagaaggactattaggaaaacttgccctgaaggctctgaggcaagccatgacacatgtgtagatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgaaaatggtgctacactctgttttgtgtgccttccttggtacttctgaggtattttcatgatcccaccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacccg

SEQ ID NO: 53 - DNA, 4187 bp, Homo sapiens
  GS-N53
  ref <308>: DATABASE ACCESSION NUMBER: GENBANK/D13643
  ref <309>: DATABASE ENTRY DATE: 2001-10-06
  ref <313>: RELEVANT RESIDUES: (1)..(4187)
ggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggccagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaagcctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctgg

SEQ ID NO: 54 - protein, 99 aa, Homo sapiens
  CDS protein of the sequence  GS-N1: 159..458
MAEGGFDPCECVCSHEHAMRRLINLLRQSQSYCTDTECLQELPGPSGDNGISVTMILVAWMVIALILFLLRPPNLRGSSLPGKPTSPHNGQDPPAPPVD

SEQ ID NO: 55 - protein, 234 aa, Homo sapiens
  CDS protein of the sequence GS-N2: 367..1071
MPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQTGEVVIIVVVLLMWAAVIGLFCRQYDIIKDNDSNNNPKEKGKGPEQSPQGRPVGTRQKKSPSINTIDV

SEQ ID NO: 56 - protein, 495 aa, Homo sapiens
  CDS protein of the sequence GS-N3: 978..2465
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 57 - protein, 1586 aa, Homo sapiens
  CDS protein of the sequence GS-N4: 1..4762
RCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 58 - protein, 217 aa, Homo sapiens
  CDS protein of the sequence GS-N5: 38..691
MAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 59 - protein, 227 aa, Homo sapiens
  CDS protein of the sequence GS-N6: 90..773
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRRRCFQCQTKLELVQQELGSCRCGYVFCMLHRLPEQHDCTFDHMGRGREEAIMKMVKLDRKVGRSCQRIGEGCS

SEQ ID NO: 60 - protein, 885 aa, Homo sapiens
  CDS protein of the sequence GS-N7: 286..2943
DSRIPKEAPDQQKKKMGPPSLVLCLLSATVFSLLGGSSAFLSHHRLKGRFQRDRRNIRPNIILVLTDDQDVELGSMQVMNKTRRIMEQGGTHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 61 - protein, 1151 aa, Homo sapiens
  CDS protein of the sequence GS-N8: 1..3456
VLCCYCKNEMSGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 62 - protein, 1175 aa, Homo sapiens
  CDS protein of the sequence GS-N9: 1..3528
QVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAGEVDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 63 - protein, 389 aa, Homo sapiens
  CDS protein of the sequence GS-N10: 618..1787
MLLPPGSLSRPRTFSSQPLQTKLMTHNGLFRPIPYVTAASADEPTASQQPPQAQLHRYNGLFRPSSCLPAFSPGPELSQVDLTRPSSCFFAASPGPAPASWWPLQAQPLPPVSLYSPNVCLTADSSGPASASLWTPQAKLPTFQQLLHTQLLPPSGLFRPSSCFTRAFPGPTFVSWQPSLARFLPVSQQPRQAQVLPHTGLSTSSLCLTVASPRPTPVPGHHLRAQNLLKSDSLVPTAASWWPMKAQNLLNLTCPGPAPASCQRLQAQPLPHGGFSRPTSSSWLGLQAQLLPHNSLFWPSSCPAHGGQCRPKTSSSQTLQAHLLLPGGINRPSFDLRTASAGPALASQGLFPGPALASWQLPQAKFLPACQQPQQAQLLPHSGPFRPNS

SEQ ID NO: 64 - protein, 152 aa, Homo sapiens
  CDS protein of the sequence GS-N11: 439..897
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 65 - protein, 793 aa, Homo sapiens
  CDS protein of the sequence GS-N12: 1..2384
SRPSCHGRLPARPPFYAPAHTLLPSFQRLSVEHCGTQPELPFSPRGERCDPPAGAAGRGGGAREKMATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLPLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 66 - protein, 639 aa, Homo sapiens
  CDS protein of the sequence GS-N13: 426..2345
MNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 67 - protein, 370 aa, Homo sapiens
  CDS protein of the sequence GS-N15: 228..1340
MAITLEEAPWLGWLLVKALMRFAFMVVNNLVAIPSYICYVIILQPLRVLDSKRFWYIEGIMYKWLLGMVASWGWYAGYTVMEWGEDIKAVSKDEAVMLVNHQATGDVCTLMMCLQDKGLVVAQMMWLMDHIFKYTNFGIVSLVHGDFFIRQGRSYRDQQLLLLKKHLENNYRSRDRKWIVLFPEGGFLRKRRETSQAFAKKNNLPFLTNVTLPRSGATKIILNALVAQQKNGSPAGGDAKELDSKSKGLQWIIDTTIAYPKAEPIDIQTWILGYRKPTVTHVHYRIFPIKDVPLETDDLTTWLYQRFVEKEDLLSHFYETGAFPPSKGHKEAVSREMTLSNLWIFLIQSFAFLSGYMWYNIIQYFYHCLF

SEQ ID NO: 68 - protein, 301 aa, Homo sapiens
  CDS protein of the sequence GS-N16: 167..1072 GS-P16
MTTLDDKLLGEKLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKMTLKEFAIMNEDQDDEEFLQQYRKQRMEEMRQQLHKGPQFKQVFEISSGEGFLDMIDKEQKSIVIMVHIYEDGIPGTEAMNGCMICLAAEYPAVKFCKVKSSVIGASSQFTRNALPALLIYKGGELIGNFVRVTDQLGDDFFAVDLEAFLQEFGLLPEKEVLVLTSVRNSATCHSEDSDLEID

SEQ ID NO: 69 - protein, 403 aa, Homo sapiens
  CDS protein of the sequence GS-N17:1030..2241 (GS-P17)
MSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 70 - protein, 975 aa, Homo sapiens
  CDS protein of the sequence GS-N18: 89..3016 (GS-P18)
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDDRERGEGQEPAFSFLATLASSSSEEMESQLQERVESSRRAVSQIVTVYDKLQEKVELLSRKLNSGDNLIVEEAVQELNSFLAQENMRLQELTDLLQEKHRTMSQEFSKLQSKVETAESRVSVLESMIDDLQWDIDKIRKREQRLNRHLAEVLERVNSKGYKVYGAGSSLYGGTITINARKFEEMNAELEENKELAQNRLCELEKLRQDFEEVTTQNEKLKVELRSAVEQVVKETPEYRCMQSQFSVLYNESLQLKAHLDEARTLLHGTRGTHQHQVELIERDEVSLHKKLRTEVIQLEDTLAQVRKEYEMLRIEFEQTLAANEQAGPINREMRHLISSLQNHNHQLKGEVLRYKRKLREAQSDLNKTRLRSGSALLQSQSSTEDPKDEPAELKPDSEDLSSQSSASKASQEDANEIKSKRDEEERERERREKEREREREREKEKEREREKQKLKESEKERDSAKDKEKGKHDDGRKKEAEIIKQLKIELKKAQESQKEMKLLLDMYRSAPKEQRDKVQLMAAEKKSKAELEDLRQRLKDLEDKEKKENKKMADEDALRKIRAVEEQIEYLQKKLAMAKQEEEALLSEMDVTGQAFEDMQEQNIRLMQQLREKDDANFKLMSERIKSNQIHKLLKEEKEELADQVLTLKTQVDAQLQVVRKLEEKEHLLQSNIGTGEKELGLRTQALEMNKRKAMEAAQLADDLKAQLELAQKKLHDFQDEIVENSVTKEKDMFNFKRAQEDISRLRRKLETTKKPDNVPKCDEILMEEIKDYKARLTCPCCNMRKKDAVLTKCFHVFCFECVKTRYDTRQRKCPKCNAAFGANDFHRIYIG

SEQ ID NO: 71 - protein, 494 aa, Homo sapiens
  CDS protein of the sequence GS-N19: 107..1591 (GS-P19)
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKEKSRSRSHSAGKSRSKSKDQAEEKIQNNDNVGKPKSRSPSRHKSKSKSRSRSQERRVEEEKRGSVSRGRSQEKSLRQSRSRSRSKGGSRSRSRSRSKSKDKRKGRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 72 - protein, 1377 aa, Homo sapiens
  CDS protein of the sequence GS-N20: 36..4169 (GS-P20) (CPD)
MASGRDERPHCVGRLLLLMCLLLLGSSARAAHIKKAEATTTTTSAGARGRGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAALPPGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSCQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQNFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTEEETLYSSKH

SEQ ID NO: 73 - protein, 2563 aa, Homo sapiens
  CDS protein of the sequence GS-N21:60..7751(GS-P21) (USP9X)
MTATTRGSPVGGNDNQGQAPDGQSLPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLVTYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLFNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYIPFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYPYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEVKKATSVQQIEMEESKEPDDQDAPDEHESPPPEDAPLYPHSPGSQYQQNNHVHGQPYTGPAAHHMNNPQRTGQRAQENYEGSEEVSPPQTKDQ

SEQ ID NO: 74 - protein, 1219 aa, Homo sapiens
  CDS protein of the sequence GS-N22: 136..3795 (GS-P22)
MLRRVTVAAVCATRRKLCEAGRDVAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFLYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLAAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGSPSSEDSNSSCEVMQLTYLPTSPLLADCIIPITDIRAFTTTLNLLPYHKIVK

SEQ ID NO: 75 - protein, 2709 aa, Homo sapiens
  CDS protein of the sequence GS-N23: 1872..10001(GS-P23)
MSAEEQLLPLARKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSGTEDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLREVSI

SEQ ID NO: 76 - protein, 2492 aa, Homo sapiens
  CDS protein of the sequence GS-N24: 216..7694 (GS-P24)
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 77 - protein, 337 aa, Homo sapiens
  CDS protein of the sequence GS-N25:28..1041 (GS-P25)
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 78 - protein, 982 aa, Homo sapiens [sequence omitted]

SEQ ID NO: 79 - protein, 114 aa, Homo sapiens
  CDS protein of the sequence GS-N27: 107..451(GS-P27)
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGEKRRCS

SEQ ID NO: 80 - protein, 215 aa, Homo sapiens
  CDS protein of the sequence GS-N28: 341..1988(GS-P28)
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 81 - protein, 5636 aa, Homo sapiens
  CDS protein of the sequence GS-N29: 230..17140 (GS-P29)
  misc_feature (3041)..(3041): Variable amino acid
  misc_feature (3003)..(3033): Variable amino acid
  misc_feature (3367)..(3367): Variable amino acid
MISWEVVHTVFLFALLYSSLAQDASPQSEIRAEEFPEGASTLAFVFDVTGSMYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVSLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPEGEESGEYVCTATNTAGYAKRKVQLTVYVRPRVFGDLRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEEGTLLVIASVTPYDNGEYICVAVNEAGTTERKYNLKVHVPPVIKDKEQVSNVSVLLNQLTNLFCEVEGTPSPIIMWYKDNVQVTESSTIQTVNNGKILKLFRATPEDAGRYSCKAINIAGTSQKYFNIDVLVPPTIIGTNFPKEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECKTRGLPMPAITWYKDGQPIMSSSQALYIDKGQYLHIPRAQVSDSATYTCHVANVAGTAEKSFHVDVYVPPMIEGNLATPLNKQVVIAHSLTLECNAAGNPSPILTWLKDGVPVKANDNFRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNCLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSTQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSTTWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIEGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNXQPIKLNTNTLIVPGGRTLQIIRAKVSDGGEYTCIAINXAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNYKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTYVDTSINIECRXTGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKATGFVYVKEPPVFKGDYPSNWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPIHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRSSYRCVCPRGYRSQGVGRPCMDIDECEQVPKPCAHQCSNTPGSFKCICPPGQHLLGDGKSCAGLERLPNYGTQYSSYNLARFSPVRNNYQPQQHYRQYSHLYSSYSEYRNSRTSLSRTRRTIRKTCPEGSEASHDTCVDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 82 - protein, 1092 aa, Homo sapiens
  CDS protein of the sequence GS-N30: 123..3401 (GS-P30)
MEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 83 - protein, 516 aa, Homo sapiens
  CDS protein of the sequence GS-N31: 100..1650 (GS-P31)
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 84 - protein, 1739 aa, Homo sapiens
  CDS protein of the sequence GS-N32: 708..5927 (GS-P32)
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECLARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 85 - protein, 801 aa, Homo sapiens [sequence omitted]

SEQ ID NO: 86 - protein, 289 aa, Homo sapiens
  CDS protein of the sequence GS-N34: 200..1069 (GS-P34)
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 87 - protein, 3664 aa, Homo sapiens
  CDS protein of the sequence GS-N35: 205..11199 (GS-P35)
MVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGELAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 88 - protein, 1616 aa, Homo sapiens
  CDS protein of the sequence GS-N36: 92..4942 (GS-P36) (PLPP)
MGIKTLNLVLGLKRALEFPEVFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 89 - protein, 914 aa, Homo sapiens
  CDS protein of the sequence GS-N37: 245..2989 (GS-P37)
MSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 90 - protein, 741 aa, Homo sapiens
  CDS protein of the sequence GS-N38: 12..2237 (GS-P38) (NUP88)
MAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 91 - protein, 108 aa, Homo sapiens
  CDS protein of the sequence GS-N39: 86..412 (GS-P39)
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 92 - protein, 1182 aa, Homo sapiens
  CDS protein of the sequence GS-N40: 115..3663 (GS-P40) (SALF)
MCSTNPGKWVTFDDDPAVQSSQKSKNFPLENQGVCRPNGLKLNLPGLREFPSGSSSTSSTPLSSPIVDFYFSPGPPSNSPLSTPTKDFPGFPGIPKAGTHVLYPIPESSSDSPLAISGGESSLLPTRPTCLSHALLPSDHSCTHPTPKVGLPDEVNPQQAESLGFQSDDLPQFQYFREDCAFSSPFWKDEGSDSHFTLDPPGSKKMFSSRNKEMPIDQKSLNKCSLNYICEKLEHLQSAENQDSLRSLSMHCLCAEENASSFVPHTLFRSQPKSGWSFMLRIPEKKNMMSSRQWGPIFLKVLPGGILQMYYEQGLEKPFKEIQLDPYCRLSEPKVENFSVAGKIHTVKIEHVSYTEKRKYHSKTEVVHEPDIEQMLKLGSTSYHDFLDFLTTVEEELMKLPAVSKPKKNYEEQEISLEIVDNFWGKVTKEGKFVESAVITQIYCLCFVNGNLECFLTLNDLELPKRDESYYEKDSEKKGIDILDYHFHKCVNVQEFEQSRIIKFVPLDACRFELMRFKTLYNGDNLPFSLKSVVVVQGAYVELQAFVNMASLAQRSSYAGSLRSCDNIRIHFPVPSQWIKALWTMNLQRQKSLKAKMNRRACLGSLQELESEPVIQVTVGSAKYESAYQAVVWKIDRLPDKNSSLDHPHCLSYKLELGSDQEIPSDWYPFATVQFSVPDTCASRTEVRSLGVESDVQPQKHVQQRACYNIQPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 93 - protein, 243 aa, Homo sapiens
  CDS protein of the sequence GS-N41: 27..758 (GS-P41)
MAAIAASEVLVDSAEEGSLAAAAELAAQKREQRLRKFRELHLMRNEARKLNHQEVVEEDKRLKLPANWEAKKARLEWELKEEEKKKECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 94 - protein, 1383 aa, Homo sapiens
  CDS protein of the sequence GS-N42: 149..4300 (GS-P42)
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 95 - protein, 838 aa, Homo sapiens
  CDS protein of the sequence GS-N43: 318..2834 (GS-P43)
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVDTTSVAEARHNPSIGEGSVGGLTGSLSASGSHMDRIGAIRDNLSETASTMALAGASITGSLSGSAMVNCFNRLEVQADVQKERYSLSGESGTVSLGTVSDNASTKAMAGSILNSYIPLDKEGNSMEVQVDIESKPSKFRHNSGSSSVDDGSATRSYAGGSSSGLPEGKSSATKWSKEATAGKKSKSGKLRKKGNMKINETREDMDAQLLEQQSTNSSEFEAPSLSDSMPSVADSHSSHFSEFSCSDLESMKTSCSHGSSDYHTRFATVNILPEVENDRLENSPHQCSISVVTQTASCSEVSQLNHIAEEHGNNGIKPNVDLYFGDALKETNNNHSHQTMELKVAIQTEI

SEQ ID NO: 96 - protein, 244 aa, Homo sapiens
  CDS protein of the sequence GS-N44: 81..815 (GS-P44)
METKPVITCLKTLLIIYSFVFWITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 97 - protein, 517 aa, Homo sapiens
  CDS protein of the sequence GS-N45: 184..1737 (GS-P45)
MKGTKDLTSQQKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 98 - protein, 590 aa, Homo sapiens
  CDS protein of the sequence GS-N46: 56..1828 (GS-P46)
  misc_feature (127)..(127): Variable amino acid
  misc_feature (462)..(462): Variable amino acid
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSCSVTQTGVQWCSHSSLQPQLPWLNXSSCLSLLRSTPAASYEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCXGSGRTLRETVLESSPILTLLNESFISTWSLVKELEELQNKQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 99 - protein, 3969 aa, Homo sapiens
  CDS protein of the sequence GS-N48: 1..11910
  MISC_FEATURE (30)..(30): Variable amino acid
MAHSCRWRFPARPGTTGGGGGGGRRGLGGXPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSVSSLILNWKSPRKSGKTRKEHLHLQKKIRQLSDKALEGLSQLGLFLLQKGQMQPLLSNSYRGQKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNRARFINHSCEPNCYSRVINIDGQKHIVIFAMRKIYRGEELTYDYKFPIEDASNKLPCNCGAKKCRKFLN

SEQ ID NO: 100 - protein, 2288 aa, Homo sapiens
  CDS protein of the sequence GS-N49: 950..7816 (GS-P49)
MSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 101 - protein, 2673 aa, Homo sapiens
  misc_feature (119)..(119): Variable amino acid
PPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLEXESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQITFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSHWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPVHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDINECEQVPKPCAHQCSNTPGSFKCICPPGQHLLGDGKSCAGLERLPNYGTQYSSYNLARFSPVRNNYQPQQHYRQYSHLYSSYSEYRNSRTSLSRTRRTIRKTCPEGSEASHDTCVDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 102 - protein, 528 aa, Homo sapiens
  CDS  protein of the sequence GS-N53: 1..1589
REPAALTARRRTMEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 103 - DNA, 257 bp, Homo sapiens
ctggttggctttccaggtaggctggatcctcttagattaggaggtctcagtaagaacaagatcaatgcaataaccatccaggctaccaagatcattgtaacactgatgccattatcaccagagggtcccggtaattcctgaagacactctgtgtctgtgcagtaggactgggactgccgtaacagattgatcagtcttctcattgcatgttcatgagagcaaacacattcacagggatcaaatccaccttctgccat

SEQ ID NO: 104 - DNA, 202 bp, Homo sapiens
gaccggggaatggaaggagatatcccatctgatatccactccccaggtccaggggcacagactctgaacagacctaccttctggctctgctcacagtggaaagaggatgggtaccaggcctgagattgtgggagtggcaataccctctgggagtctcgggcagatcaccatcttgggctccccctgaccccatccctatccc

SEQ ID NO: 105 - DNA, 242 bp, Homo sapiens
tgggtggggaaggcaatctagctcactcagcagggaaaatggagctccccaatggataactttttatgctcataaaccctgaaatagtactaaaaatgagaaaaatccccaagacttctctgattcccaggttgggattagctgagggaataggaacaaaggaccagaatcctacttccatgagccatgcctggagtcagtattgtctccagtgtctactccctgaaatcggttcctccagc

SEQ ID NO: 106 - DNA, 211 bp, Homo sapiens
ggggatgtcccatcttgtgctagagccaataaaatgctgacactggtcttcagatgttgtcctgagcctattccaccaacataacgatgcaaacaaccaagagccaatgaatgaccagtcctagatacaacatctcgagccgatttcaacttgtcaaagctatattgggccattctagcaataaaagttgcttctccaaccacctgagcca

SEQ ID NO: 107 - DNA, 191 bp, Homo sapiens
ccgacacacgtccttggagacttgcctcatcaacttctctgcattcagaccttgcttctgctcttctttggactgttcagcctgcttctcagcttgcttcagaagcctctggaacctctcatcctccagcacacctggtggaaggtcagtctctccctgagctttcagttcctccagcttctgccgcaagt

SEQ ID NO: 108 - DNA, 238 bp, Homo sapiens
acgagaatggaggccacgacatcatcctcttggcccctggaggcacgggcggctccagctggaaggggcagagcccgtgggcggcagcttccccagctgctgctcccagcacttctactgattcttgttggctatgaaatgtctttttaaaaaactcccaatatagaaatctggctgcagaggccagtgtgcagacccagccaccgcgctgtgctgccattcgccacatctggtccgt

SEQ ID NO: 109 - DNA, 205 bp, Homo sapiens
tgcgtgcttgctttctcaggcctcctggtcaatagcacaggtctgctggaaatcacccacatggtttttcattgcctgtgcagtcaggtgatgcctctatgtttttggaggtccacctctgttgtttcttaaccttcccagccttcccacagttgtcccagtgatttggaagaaggtctcttcatttctggccactttcgacgct

SEQ ID NO: 110 - DNA, 186 bp, Homo sapiens
ccgtccattcttatcctccatctgaaggtggtactgaatagaatcggttgacaatgtctttggagttccttctccccatttcagcttaaggttctggtggctaaaggcaacacattccagacgaggtggatcaggagggagaggcttagtttttaattttatcgtatggctgaaaggaccagctcc

SEQ ID NO: 111 - DNA, 223 bp, Homo sapiens
ggaggggagagaacccaacacatgaggtctgcacacacagctgtcctggttgccctcggtgcagctccgagctccagttacaaggaattccaagttctcaggatcttgaagactctggaggccagtaatccctggatcacactgcttctaccagctcagaagagaagtcctgcctaaggtcatgaaataaacctgactgctgccaccagaccgaacagaggca

SEQ ID NO: 112 - DNA, 247 bp, Homo sapiens
gatggagctgtgcctgtggaggctgttgtgaggcagtaggctcatctgcggagactgccgtgaggtagggtatgggcctaaataggccattgtgagtcatgagcttggtctgtagaggctgactggagaaagttctgggcctggagaggctgccgggtggtaggagcataatgtaaaatcagtgggcgtgttaagcttgttttcctgcaactggatggtcccacgttttgctgtcacccctctggaa

SEQ ID NO: 113 - DNA, 162 bp, Homo sapiens
gctgggttcagttccttgtgcccactgtccctgcagacgctctcctttccaggtggcctccagtggtttcccgggtcctgctgctccctaatagtagcgattcaggctcctggtcccgggcacctcaggctggccattcatccagatctccctgatgatgcg

SEQ ID NO: 114 - DNA, 166 bp, Homo sapiens
aagtttgggaaccgctggtgatgggacatggatgcttgcaaccgaccgtgggcggatgtggttgaccagatggcagaggacgacaccatccatgagggctgcccccaggtcttcgtgtagactgaccttcaatctcatctcaatgctctcacgaagttgttccacc

SEQ ID NO: 115 - DNA, 135 bp, Homo sapiens
gcgcttgttaggggctgaagcagaagagtcagagttctgaagagtaagagaagatagtgaagccagcccacttgtgacagcagaggataaagcagaggagttgattaaattggtgtcattggatgtcagaaaacc

SEQ ID NO: 116 - DNA, 136 bp, Homo sapiens
ttccacatccttgtgggtcatatacttcaggaaatagacaggtttagtatgaccaacagtaatagtaatacagttccttgggtttatagttgcatctgcttaaaatccttaaccagatgactagatcttgcgcaga

SEQ ID NO: 117 - DNA, 552 bp, Homo sapiens
gcggccgcgaattcactagtgattcattatgctgagtgatatctttttttttaatatacttttggaattctcagtgaatttgtttgcttgcccaaaatattattttccattctgtaatttttctttaccttccattacttacaggtttctctgcaatttaagtacagttcaccaccaataattgtttctgaagttaagggtgacctgctggcttggtcacttttgcagtgactggacctgcctgtggccaagcacatgttccatcactgtaactcatcaataccaagattccagcaatggattctcaaccttgtctgctgtgggaatctaggcagtctagccaagaccaagaagagctgagcttctgcaagctattgatataaaactggcatagttttatcttctttcctcttgacaaaatatatatactttaaacgtcctttcatctcccttcacgaagtacaaattaggaacttttcttcagttttgtacagtggcatgttgctgcttccccagcatttagtgagggttaataatcgaattcccgcggcc

SEQ ID NO: 118 - DNA, 417 bp, Homo sapiens
ccctggaatgccatcctcataaatatgaaccatgatgacaatgcttttctgttctttatcaatcatgtctaaaaacccttctccactggagatctcaaaaacctgcttgaattggggccccttgtgaagctgctgccgcatctcttccattcgctgcttccggtactgctgcaggaactcttcatcatcttggtcctcattcattatggcaaactccttcagagtcatcttcccactgatcttctcctggaggtctttctgtttctgttgctcctcctcttcatccagatgggacctgcaagtcattgacagcctcttgatcagcctttccatctcccggcactgctcctccctctgctctgtctccaactgcttgaagcggcgccagtcattgatcacaccttttgggcctgtgtt

SEQ ID NO: 119 - DNA, 244 bp, Homo sapiens
tgagaccccaccaactgcaaaatctgttcctggcattaagctccttcttcctttgcaattcggtctttcttcagcggtcccatgaatgctttcttctcctccatggtctggaagtggccatggccaaacttggaggtggtgtcaatgaacttaaggtcaatcttctccagagcccgccgcttcgtctgcaccagcaaggacttgcggagggtgagcacccgcttcttggttcccaccacacagc

SEQ ID NO: 120 - DNA, 311 bp, Homo sapiens
gctggtgggttcctctggtgccatgaagcagggtccgagcctcacccaagtgtgctttcaactgtaggctctcattatacaagacggagaactgtgactgcatgcagcgatattctggagtttccttaacgacttgctccactgcactccgcaattccaccttcagcttttcattttgtgtagtgacctcctcaaagtcttgccgaagtttctccagctcacagagacggttctgagccaactctttgttctcctcaagctctgcattcatttcctcaaacttccgagcattgatagtgattgtgccgcca

SEQ ID NO: 121 - DNA, 246 bp, Homo sapiens
gctcttacgggaatgtctgcttcgagagcgagaccttgaatgactccggcttctggagtaggaccggcgtcgtctggaacctggcttgtcttcaactaatctgatttttctcccattgacttcagttccatccaacttttccaaagctcttttcatatcagaataagatacaaattcaatcaccccttcatttttgcgtcccttgtgagcatctgcataagtcacttctcctgcctgacgcatata

SEQ ID NO: 122 - DNA, 203 bp, Homo sapiens
cagatcttgtagatggctgggtcatctgaaaaccatgtgtgcaacatagaaaaaggttccgatttaggcaatattaaagaatcaggcattcctagaataagctagtgcttcacagatataagcagcagcacctgtgggtttttaccaagttcaaagatagacaacatgagttttagcttttgctagatctctctcccagctcc

SEQ ID NO: 123 - DNA, 253 bp, Homo sapiens
ttccactgcaggcgggttatatattgacagcaaatttctgcagataagacagtgaataaactctccactccatgttgattaggaatagtttttctagttttaaatattagccagacacagaaaaaggttggactgtaaggcctgggtgcacagtcttgatggaaccagttaattatgtgcatttcattgatccttggtttgaggtggggatacttcttcactgccttcataattttcttgtgctcgttggcca

SEQ ID NO: 124 - DNA, 173 bp, Homo sapiens
gaaaggccgtccatcaaagcctggtacttgtcaatcatagaccaacgggcatattccaggattaaaagccgtacatctttggccaaagtctcgggcttgatgaggatgttaaagtaggtcttcttcaactgctcagttatcattgtaaagacagctggtgtggaattgaactc

SEQ ID NO: 125 - DNA, 228 bp, Homo sapiens
ccgggtggtcaagacagacagatcagatggtagctctagaggcaactcaaactgttcctctgctgagatagaggaagagacactactatccacaggttctgttgtaggcagctgctgagaaaatacttcaaaaagacatgggtctttttcacgattactgtcaagacccaatccttcaccaagattcaggagttctgatgaagatgactctgggctctcacccaaagc

SEQ ID NO: 126 - DNA, 381 bp, Homo sapiens
aaaatgacgctccacctgctgctgatcaacaactcgaaaagacagtgactgcttagttacttgccgatcataaatcttatcttccatggttccctgagctaagaacctatatacataaacaggcttagtttgtccaaagcgataaactctgaatatactctggatgtcataagatggattccaagaagcgtcgaatataattactcgattagcagctaccagattaattcctagagatcctgctttagtagaaatgataaatgatcgtcctctcacattagtttcatcattaaattcttcagcccacttcttccttgactgtgcagtagtggaaccatctaaacggtaatagtcaatgtttcgaagccacttcccctcacc

SEQ ID NO: 127 - DNA, 395 bp, Homo sapiens
cccttagacattgtcccaaaccttgttacttgagtattgtagccttaccatgattttttttaacaccgtatcatctccatactttttatttacaaattatatatacacacaataatacaattccttcattctaaaacaatagtagaccccaaacaggtctacattaagtttctgtactagcagttcactcagatagcttcgtttgtttgttgttgtttccacataaccgcactgatcatgccatacagttaatttttatttgtttatgctaccttctgagattaacttaaggctctagtttaatgcaaatggtttagtcttaaaaggagtctcacgtgaggctaaaatcacacaccaataactctcctttgaagctgtttctccttggtggatgg

SEQ ID NO: 128 - DNA, 381 bp, Homo sapiens
ttccctgctgccatcaatcagggcttgaaataagggcttgttatgaggtatggtctgtaagatattcccatccccagtcacatagccaatggcccactgtcccaatcgagtgcaacttaaccggaaaatatagcttccgggtttggtgctatatttctgtagtcgtgcattaacttcatcatatgtgagaaatgccatgtaacctggatgtgtcacagctaagaaattccaattccgcaaaatagagccccaaggctgaaacagcctggtaaaaatatcaaattcaaaaactgaaatgtaatcattgcaagttaaatcaattgttgattttagagccattgcttccaggccagagctaatctggtggacctcatgaaggca

SEQ ID NO: 129 - DNA, 298 bp, Homo sapiens
cgagtgggcaggcctgtatcttctcagcaaagtaaggattgagtatagagagctgtttgtcttaactgggcttccctgaagaatctgagccaaactggaagaaaccagcctcatttccagtgttgagatgttagctgtacagtggctgtacaactgcagagtttatttatagaattagaaataatttttaaaattttaaaaggttttgtgtaatcattaaccagagatgatattcacaaattctggtaaaaatttgactctccaactatcaccatatcaacaggaaacagggccatgc

SEQ ID NO: 130 - DNA, 413 bp, Homo sapiens
tgggaagcattggctggttctcacagtacacacgaggacagtaaccaaagtctccttgctggtacttttccaacatctgggcgatgccacggttggtaaggatgtagcgggcgtggatcaatccataaagcatctcggctgcctgctcaatcaggtcactctggttggggttgtcttccagttcttcatcaggctccaggtccaagatcatgtctagagcttgtcgatagtgagggacctgctcattgagtccagtaagattaaatttgtcctggatgtagtcttcatccacttcacagaagaattcattgccacggagcccacagaaccaggaaatccaggacacctcctctgagctgctcatcttcacgtcagcggctggacggggaccaggactggggtggggtagggaa

SEQ ID NO: 131 - DNA, 564 bp, Homo sapiens
tcccacaactttcgctgcatgttccccaaggctgccaagcgctccatgctccatgaactgggcaaggcctaatgttgcacataattatttccacagcattcccttcacatggccgcccaccatgctgaactgatggattattgcaagtcctggtcctggtttggttgccgcgtccacagctccttgtgcattcttcccaaagactccattccgaccagctaccatccactggacaaggcttattttgacagtttcgcatttccaaatctgaaccttggcagggcttcccaccattggctggaaggggctggttgcacagacgactcctcttttggatgccttttccacaggtgacactgcaggctctccatgcagaccactgggaaaatccaccatgaacctggactatgactggcactctgacaaggacagaacccattaagtttcgagcaacacattcaaattcagagatatcttctttctgagcatcagcaatatataatgagttgttggacaacacgttaacccggtcatcccaggaaatagagtgcccttgacgggacc

SEQ ID NO: 132 - DNA, 414 bp, Homo sapiens
tgaggctgggttctgggttccctgcaaggccattaaatcttgggacacttgctcccgtaactgtttgagtttcttctcaataacatgcaccttttcttcagcttcaatacggtcttctccatgtcccttaatgagaaggctgtttgaaatctcctgtaacatgtccacttgaggttgacgttctaccagctccttttccagttgcattagttccctccgacactctaggagagcccgggggtctgcctttggatcggtgacatgagccttctgcctccggttcttggcactcgctaaccacagcagcagattttgactcaactggtggaagtcctggcactgcatgagcgactgtcgtaagccccctctccagctgtccactgcgccctgtgctgcttcccagagcaggctcag

SEQ ID NO: 133 - DNA, 298 bp, Homo sapiens
agctggccttggggttgaaggaaggatcttgaatgacagataatccccaagtgtccactggatcatttttcctctgactttccacacaaatgaggctttccatgggctttgcaaccacagtgtctaagacaatcagaagggttccagggaggtcttgtctgtagcgatgtgacagatgaggaaactgcagctcagaggacaatgacttgcccacgttgcacagctcgctgacagtagagaggggctgaaacctaggtctcctgactcacacgccacaaccatgactggctcagctccc

SEQ ID NO: 134 - DNA, 365 bp, Homo sapiens
cctctttcagcctgggcactttgttttccttctttacccgaggcttccgcttctttaatttggcctcttccccacctgtcacagcccccttcttctccagaccctttctgagcagcttcaacaagtattccgctcgggtctgtagctgcttcccctgaggcttcttatctgtctccaccggcaggattttgtcagttaatttaagctctgggtctgttttaattaactcccagtttccatagccatgttcataaatccccagcaacaggcgagaatcatcttccaccctccactctacatcaaaatgtgcagctttgacacgacaggttaagcagtattttttttttcttcagggtccacaggga

SEQ ID NO: 135 - DNA, 270 bp, Homo sapiens
tggaagcgctaaggcgtgacactgctacttgctgtgcagaggatgactctgttttctcattcgctttcttggggggctttttagtagaattgagctgtccgctgacatcttgtaaccgcttttctaattcccgctttttctccaaagccagttcctcctttgtctttcccacaggcttcttaatggtgtagggcttccggggtttcttacgtaggcaggaaaggacatagcgctcaagctctctaagtgtggatggcttgagtgcttcaa

SEQ ID NO: 136 - DNA, 298 bp, Homo sapiens
ttccgggcctgactctggtatttcacagcttttttcgtttcatctcgtgccttctccacgtggtccactgtgtgcatgacattcaactctatgttatctaacatctcaccctgattctccaccagcatggcgatgtccataaacatgtcgtgaagctccttgatgctgctctccagcctcacaatgtccttgtgtcgtccctcaatctcactgagggcttgcttggaaatctgtgagtcaatgatcccagaagtgaagatggccgggttgccactctccaacatctcctccagctcca

SEQ ID NO: 137 - DNA, 117 bp, Homo sapiens
tgcttggtgtgcaggcttgtccctgtcctctggggcaaggccctctggtgcatctgccttataggcagcagaggcagaggcctcagcgagctttgcgatgtgttccacggcctgctc

SEQ ID NO: 138 - DNA, 96 bp, Homo sapiens
tggagctgggtgagttgatgaagatgccactggaatcataagaggatcttgttgtcttgatatcggagatctcatcagaggttgtaggttcctctg

SEQ ID NO: 139 - DNA, 393 bp, Homo sapiens
tccaaggatttggcctgtggctggggaaataacacacacgagataggtaacaaggatttacactgacatatggggtgttggtttggctctattctttttcggttaccacttcttgcagtgtaggtggagatgcctctgttccttcttcccagccctcagcaacaccagcaagctcgtagtgctttttccgaagctctcccagtttttgacgctccttctgcaattcattttctagctctagcaccctaacctgagaatccatctcttggcgtttgatctgtgtcagcgtcatgcttgagaagtccatgttgtctgtctcttcgatctgtgatttgccggaaatggttgaggccacaacgccggcagtggcctggttcactccccgagaggcct

SEQ ID NO: 140 - DNA, 100 bp, Homo sapiens
ctgtagagagttcctgtaaactatccttatcttcttcatctgatccaagaaatttgtgaagtttatgaatccaagttagcccaacactatgtacaccagc

SEQ ID NO: 141 - DNA, 90 bp, Homo sapiens
gctgggggaagggtgcagcaacgatttctcaccaaatcactacacaggacagcaaaggggtgagaaggggctgagggaggaaaagccagg

SEQ ID NO: 142 - DNA, 144 bp, Homo sapiens
tggaggaagatccactgggaaattccctgaggccaggaaggttcagcttcagtccatttggtctacagacaccttgattctccagaggaaaattctttgacttttgagaagattgaacagcaggatcatcatcaaaggtgaccc

SEQ ID NO: 143 - DNA, 113 bp, Homo sapiens
cgagcttcattccgcatcaggtgcagctcccggaatttgcgcagtctctgttcgcgcttctgagcggccagctccgccgccgcagcgagggacccctcctccgcgctgtccac

SEQ ID NO: 144 - DNA, 180 bp, Homo sapiens
tggttccgttgggttaacagtgtcattttaaaatgccataaattaaataagttagttcacattttttttcccccagcacttaagttacagttagtctctaatgtgcttttgaagcttgctttagctgttccaggtctcttctgcggacagtggtggctctgggacaaccatattcgtcca

SEQ ID NO: 145 - DNA, 507 bp, Homo sapiens
gcaaaaactgccacaatcttgctcaaagtgtctaagtatccaaatggtagcaaatgagctgcattaagctttatataaccacattgcatatgaagaaaaaaaatgaaatttatgccgatataaatagaaatgttacagagtatcatatactgagagtaacctatgcagttcttttaaacttatctctttagtggtttcaataaaatatcactaaccacttatccctaaagcctcaagttttcttcatttgaatgctgtagaattgcattagtattttatattgattatataaattaagaccaatttctatctaagtatgtgcttcaagcaatgttttgtggcaaacacacaaaacatgctttgctcttcaaatttattatccttaaaataatgcacttttaaagccttcacttcatagtttggtaactaagatccacatgatacacaatgccttgctgaacacagaaaatgtatctgcattatgataatgaaacccggcttttgctg

SEQ ID NO: 146 - DNA, 632 bp, Homo sapiens
ggcagcctgaagaaggtaggaaagccttagtagagggaaaatcaaaccaaatgagattaggtcaaaagaacagataactatcgtctgcttatctacttaaaggtgtgtggcatttaccacagtgaggagctaacaggagcctcccacactacatgcagggcccaaaggggccagcgatggtgtgataaccagtcaccgatgatgagttgcagttggaccacgtacagatggaggggctggcccatgcagggcctcggggtgaggttcactaggactagctgcagggggacctggctacactctgtggcacaacagggcttcacaaaatggacactacacgtgacgtgggctgaaaggtggagcagagactgggtgggagtgtcagttgtacgttgtggggtaagggggagagggagcagggcaagtgtattatgtactgtgctctaacattctttggaagtctttcaaagattgctgcagttcctttttaaaacaggtctcttattccgtcattcttgaaagacttctccttacaccatctcatactgattggccgtgatgaaccgggacagacagcaggccagcagcatgccaattaactgggagaatgcgattccaaacgccactccagc

SEQ ID NO: 147 - DNA, 704 bp, Homo sapiens
gcaagcctatgatggccactgtgaaaaggaccagggagaatagaaccatgaggaagacataggtggagtgggaggaaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctctcaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccag

SEQ ID NO: 148 - DNA, 257 bp, Homo sapiens
ggccgcgggaattcgattattaaccctcactaaatgctggggatcatggatcctctgaggactgtttttaaaaagctgaagaggagaaggaagagaggactacttcttcccataggtgcagctgcaaagacatcaagctggacccatcgaggatttcggattcagccatcatggggctgctgccggggaagccactgcccctcctttctccccagcatttagtgagggttaataatcactagtgaattcgcggccgc

SEQ ID NO: 149 - DNA, 5717 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtctggttggctttccaggtaggctggatcctcttagattaggaggtctcagtaagaacaagatcaatgcaataaccatccaggctaccaagatcattgtaacactgatgccattatcaccagagggtcccggtaattcctgaagacactctgtgtctgtgcagtaggactgggactgccgtaacagattgatcagtcttctcattgcatgttcatgagagcaaacacattcacagggatcaaatccaccttctgccatgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 150 - DNA, 5662 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgaccggggaatggaaggagatatcccatctgatatccactccccaggtccaggggcacagactctgaacagacctaccttctggctctgctcacagtggaaagaggatgggtaccaggcctgagattgtgggagtggcaataccctctgggagtctcgggcagatcaccatcttgggctccccctgaccccatccctatcccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 151 - DNA, 5702 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttgggtggggaaggcaatctagctcactcagcagggaaaatggagctccccaatggataactttttatgctcataaaccctgaaatagtactaaaaatgagaaaaatccccaagacttctctgattcccaggttgggattagctgagggaataggaacaaaggaccagaatcctacttccatgagccatgcctggagtcagtattgtctccagtgtctactccctgaaatcggttcctccagcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 152 - DNA, 5671 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtggggatgtcccatcttgtgctagagccaataaaatgctgacactggtcttcagatgttgtcctgagcctattccaccaacataacgatgcaaacaaccaagagccaatgaatgaccagtcctagatacaacatctcgagccgatttcaacttgtcaaagctatattgggccattctagcaataaaagttgcttctccaaccacctgagccagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 153 - DNA, 5651 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtccgacacacgtccttggagacttgcctcatcaacttctctgcattcagaccttgcttctgctcttctttggactgttcagcctgcttctcagcttgcttcagaagcctctggaacctctcatcctccagcacacctggtggaaggtcagtctctccctgagctttcagttcctccagcttctgccgcaagtgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 154 - DNA, 5698 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtacgagaatggaggccacgacatcatcctcttggcccctggaggcacgggcggctccagctggaaggggcagagcccgtgggcggcagcttccccagctgctgctcccagcacttctactgattcttgttggctatgaaatgtctttttaaaaaactcccaatatagaaatctggctgcagaggccagtgtgcagacccagccaccgcgctgtgctgccattcgccacatctggtccgtgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 155 - DNA, 5665 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttgcgtgcttgctttctcaggcctcctggtcaatagcacaggtctgctggaaatcacccacatggtttttcattgcctgtgcagtcaggtgatgcctctatgtttttggaggtccacctctgttgtttcttaaccttcccagccttcccacagttgtcccagtgatttggaagaaggtctcttcatttctggccactttcgacgctgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 156 - DNA, 5646 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtccgtccattcttatcctccatctgaaggtggtactgaatagaatcggttgacaatgtctttggagttccttctccccatttcagcttaaggttctggtggctaaaggcaacacattccagacgaggtggatcaggagggagaggcttagtttttaattttatcgtatggctgaaaggaccagctccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 157 - DNA, 5683 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtggaggggagagaacccaacacatgaggtctgcacacacagctgtcctggttgccctcggtgcagctccgagctccagttacaaggaattccaagttctcaggatcttgaagactctggaggccagtaatccctggatcacactgcttctaccagctcagaagagaagtcctgcctaaggtcatgaaataaacctgactgctgccaccagaccgaacagaggcagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 158 - DNA, 5707 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgatggagctgtgcctgtggaggctgttgtgaggcagtaggctcatctgcggagactgccgtgaggtagggtatgggcctaaataggccattgtgagtcatgagcttggtctgtagaggctgactggagaaagttctgggcctggagaggctgccgggtggtaggagcataatgtaaaatcagtgggcgtgttaagcttgttttcctgcaactggatggtcccacgttttgctgtcacccctctggaagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 159 - DNA, 5622 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgctgggttcagttccttgtgcccactgtccctgcagacgctctcctttccaggtggcctccagtggtttcccgggtcctgctgctccctaatagtagcgattcaggctcctggtcccgggcacctcaggctggccattcatccagatctccctgatgatgcggtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 160 - DNA, 5626 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtaagtttgggaaccgctggtgatgggacatggatgcttgcaaccgaccgtgggcggatgtggttgaccagatggcagaggacgacaccatccatgagggctgcccccaggtcttcgtgtagactgaccttcaatctcatctcaatgctctcacgaagttgttccaccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 161 - DNA, 5595 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgcgcttgttaggggctgaagcagaagagtcagagttctgaagagtaagagaagatagtgaagccagcccacttgtgacagcagaggataaagcagaggagttgattaaattggtgtcattggatgtcagaaaaccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 162 - DNA, 5596 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtttccacatccttgtgggtcatatacttcaggaaatagacaggtttagtatgaccaacagtaatagtaatacagttccttgggtttatagttgcatctgcttaaaatccttaaccagatgactagatcttgcgcagagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 163 - DNA, 6012 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgcggccgcgaattcactagtgattcattatgctgagtgatatctttttttttaatatacttttggaattctcagtgaatttgtttgcttgcccaaaatattattttccattctgtaatttttctttaccttccattacttacaggtttctctgcaatttaagtacagttcaccaccaataattgtttctgaagttaagggtgacctgctggcttggtcacttttgcagtgactggacctgcctgtggccaagcacatgttccatcactgtaactcatcaataccaagattccagcaatggattctcaaccttgtctgctgtgggaatctaggcagtctagccaagaccaagaagagctgagcttctgcaagctattgatataaaactggcatagttttatcttctttcctcttgacaaaatatatatactttaaacgtcctttcatctcccttcacgaagtacaaattaggaacttttcttcagttttgtacagtggcatgttgctgcttccccagcatttagtgagggttaataatcgaattcccgcggccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 164 - DNA, 5877 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtccctggaatgccatcctcataaatatgaaccatgatgacaatgcttttctgttctttatcaatcatgtctaaaaacccttctccactggagatctcaaaaacctgcttgaattggggccccttgtgaagctgctgccgcatctcttccattcgctgcttccggtactgctgcaggaactcttcatcatcttggtcctcattcattatggcaaactccttcagagtcatcttcccactgatcttctcctggaggtctttctgtttctgttgctcctcctcttcatccagatgggacctgcaagtcattgacagcctcttgatcagcctttccatctcccggcactgctcctccctctgctctgtctccaactgcttgaagcggcgccagtcattgatcacaccttttgggcctgtgttgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 165 - DNA, 5704 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttgagaccccaccaactgcaaaatctgttcctggcattaagctccttcttcctttgcaattcggtctttcttcagcggtcccatgaatgctttcttctcctccatggtctggaagtggccatggccaaacttggaggtggtgtcaatgaacttaaggtcaatcttctccagagcccgccgcttcgtctgcaccagcaaggacttgcggagggtgagcacccgcttcttggttcccaccacacagcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 166 - DNA, 5771 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgctggtgggttcctctggtgccatgaagcagggtccgagcctcacccaagtgtgctttcaactgtaggctctcattatacaagacggagaactgtgactgcatgcagcgatattctggagtttccttaacgacttgctccactgcactccgcaattccaccttcagcttttcattttgtgtagtgacctcctcaaagtcttgccgaagtttctccagctcacagagacggttctgagccaactctttgttctcctcaagctctgcattcatttcctcaaacttccgagcattgatagtgattgtgccgccagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 167 - DNA, 5706 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgctcttacgggaatgtctgcttcgagagcgagaccttgaatgactccggcttctggagtaggaccggcgtcgtctggaacctggcttgtcttcaactaatctgatttttctcccattgacttcagttccatccaacttttccaaagctcttttcatatcagaataagatacaaattcaatcaccccttcatttttgcgtcccttgtgagcatctgcataagtcacttctcctgcctgacgcatatagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 168 - DNA, 5663 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtcagatcttgtagatggctgggtcatctgaaaaccatgtgtgcaacatagaaaaaggttccgatttaggcaatattaaagaatcaggcattcctagaataagctagtgcttcacagatataagcagcagcacctgtgggtttttaccaagttcaaagatagacaacatgagttttagcttttgctagatctctctcccagctccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 169 - DNA, 5713 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtttccactgcaggcgggttatatattgacagcaaatttctgcagataagacagtgaataaactctccactccatgttgattaggaatagtttttctagttttaaatattagccagacacagaaaaaggttggactgtaaggcctgggtgcacagtcttgatggaaccagttaattatgtgcatttcattgatccttggtttgaggtggggatacttcttcactgccttcataattttcttgtgctcgttggccagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 170 - DNA, 5633 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgaaaggccgtccatcaaagcctggtacttgtcaatcatagaccaacgggcatattccaggattaaaagccgtacatctttggccaaagtctcgggcttgatgaggatgttaaagtaggtcttcttcaactgctcagttatcattgtaaagacagctggtgtggaattgaactcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 171 - DNA, 5688 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtccgggtggtcaagacagacagatcagatggtagctctagaggcaactcaaactgttcctctgctgagatagaggaagagacactactatccacaggttctgttgtaggcagctgctgagaaaatacttcaaaaagacatgggtctttttcacgattactgtcaagacccaatccttcaccaagattcaggagttctgatgaagatgactctgggctctcacccaaagcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 172 - DNA, 5841 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtaaaatgacgctccacctgctgctgatcaacaactcgaaaagacagtgactgcttagttacttgccgatcataaatcttatcttccatggttccctgagctaagaacctatatacataaacaggcttagtttgtccaaagcgataaactctgaatatactctggatgtcataagatggattccaagaagcgtcgaatataattactcgattagcagctaccagattaattcctagagatcctgctttagtagaaatgataaatgatcgtcctctcacattagtttcatcattaaattcttcagcccacttcttccttgactgtgcagtagtggaaccatctaaacggtaatagtcaatgtttcgaagccacttcccctcaccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 173 - DNA, 5855 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtcccttagacattgtcccaaaccttgttacttgagtattgtagccttaccatgattttttttaacaccgtatcatctccatactttttatttacaaattatatatacacacaataatacaattccttcattctaaaacaatagtagaccccaaacaggtctacattaagtttctgtactagcagttcactcagatagcttcgtttgtttgttgttgtttccacataaccgcactgatcatgccatacagttaatttttatttgtttatgctaccttctgagattaacttaaggctctagtttaatgcaaatggtttagtcttaaaaggagtctcacgtgaggctaaaatcacacaccaataactctcctttgaagctgtttctccttggtggatgggtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 174 - DNA, 5841 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtttccctgctgccatcaatcagggcttgaaataagggcttgttatgaggtatggtctgtaagatattcccatccccagtcacatagccaatggcccactgtcccaatcgagtgcaacttaaccggaaaatatagcttccgggtttggtgctatatttctgtagtcgtgcattaacttcatcatatgtgagaaatgccatgtaacctggatgtgtcacagctaagaaattccaattccgcaaaatagagccccaaggctgaaacagcctggtaaaaatatcaaattcaaaaactgaaatgtaatcattgcaagttaaatcaattgttgattttagagccattgcttccaggccagagctaatctggtggacctcatgaaggcagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 175 - DNA, 5758 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtcgagtgggcaggcctgtatcttctcagcaaagtaaggattgagtatagagagctgtttgtcttaactgggcttccctgaagaatctgagccaaactggaagaaaccagcctcatttccagtgttgagatgttagctgtacagtggctgtacaactgcagagtttatttatagaattagaaataatttttaaaattttaaaaggttttgtgtaatcattaaccagagatgatattcacaaattctggtaaaaatttgactctccaactatcaccatatcaacaggaaacagggccatgcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 176 - DNA, 5873 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttgggaagcattggctggttctcacagtacacacgaggacagtaaccaaagtctccttgctggtacttttccaacatctgggcgatgccacggttggtaaggatgtagcgggcgtggatcaatccataaagcatctcggctgcctgctcaatcaggtcactctggttggggttgtcttccagttcttcatcaggctccaggtccaagatcatgtctagagcttgtcgatagtgagggacctgctcattgagtccagtaagattaaatttgtcctggatgtagtcttcatccacttcacagaagaattcattgccacggagcccacagaaccaggaaatccaggacacctcctctgagctgctcatcttcacgtcagcggctggacggggaccaggactggggtggggtagggaagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 177 - DNA, 6024 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttcccacaactttcgctgcatgttccccaaggctgccaagcgctccatgctccatgaactgggcaaggcctaatgttgcacataattatttccacagcattcccttcacatggccgcccaccatgctgaactgatggattattgcaagtcctggtcctggtttggttgccgcgtccacagctccttgtgcattcttcccaaagactccattccgaccagctaccatccactggacaaggcttattttgacagtttcgcatttccaaatctgaaccttggcagggcttcccaccattggctggaaggggctggttgcacagacgactcctcttttggatgccttttccacaggtgacactgcaggctctccatgcagaccactgggaaaatccaccatgaacctggactatgactggcactctgacaaggacagaacccattaagtttcgagcaacacattcaaattcagagatatcttctttctgagcatcagcaatatataatgagttgttggacaacacgttaacccggtcatcccaggaaatagagtgcccttgacgggaccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 178 - DNA, 5874 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttgaggctgggttctgggttccctgcaaggccattaaatcttgggacacttgctcccgtaactgtttgagtttcttctcaataacatgcaccttttcttcagcttcaatacggtcttctccatgtcccttaatgagaaggctgtttgaaatctcctgtaacatgtccacttgaggttgacgttctaccagctccttttccagttgcattagttccctccgacactctaggagagcccgggggtctgcctttggatcggtgacatgagccttctgcctccggttcttggcactcgctaaccacagcagcagattttgactcaactggtggaagtcctggcactgcatgagcgactgtcgtaagccccctctccagctgtccactgcgccctgtgctgcttcccagagcaggctcaggtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 179 - DNA, 5758 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtagctggccttggggttgaaggaaggatcttgaatgacagataatccccaagtgtccactggatcatttttcctctgactttccacacaaatgaggctttccatgggctttgcaaccacagtgtctaagacaatcagaagggttccagggaggtcttgtctgtagcgatgtgacagatgaggaaactgcagctcagaggacaatgacttgcccacgttgcacagctcgctgacagtagagaggggctgaaacctaggtctcctgactcacacgccacaaccatgactggctcagctcccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 180 - DNA, 5825 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtcctctttcagcctgggcactttgttttccttctttacccgaggcttccgcttctttaatttggcctcttccccacctgtcacagcccccttcttctccagaccctttctgagcagcttcaacaagtattccgctcgggtctgtagctgcttcccctgaggcttcttatctgtctccaccggcaggattttgtcagttaatttaagctctgggtctgttttaattaactcccagtttccatagccatgttcataaatccccagcaacaggcgagaatcatcttccaccctccactctacatcaaaatgtgcagctttgacacgacaggttaagcagtattttttttttcttcagggtccacagggagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 181 - DNA, 5730 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttggaagcgctaaggcgtgacactgctacttgctgtgcagaggatgactctgttttctcattcgctttcttggggggctttttagtagaattgagctgtccgctgacatcttgtaaccgcttttctaattcccgctttttctccaaagccagttcctcctttgtctttcccacaggcttcttaatggtgtagggcttccggggtttcttacgtaggcaggaaaggacatagcgctcaagctctctaagtgtggatggcttgagtgcttcaagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 182 - DNA, 5758 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtttccgggcctgactctggtatttcacagcttttttcgtttcatctcgtgccttctccacgtggtccactgtgtgcatgacattcaactctatgttatctaacatctcaccctgattctccaccagcatggcgatgtccataaacatgtcgtgaagctccttgatgctgctctccagcctcacaatgtccttgtgtcgtccctcaatctcactgagggcttgcttggaaatctgtgagtcaatgatcccagaagtgaagatggccgggttgccactctccaacatctcctccagctccagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 183 - DNA, 5577 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttgcttggtgtgcaggcttgtccctgtcctctggggcaaggccctctggtgcatctgccttataggcagcagaggcagaggcctcagcgagctttgcgatgtgttccacggcctgctcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 184 - DNA, 5556 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttggagctgggtgagttgatgaagatgccactggaatcataagaggatcttgttgtcttgatatcggagatctcatcagaggttgtaggttcctctggtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 185 - DNA, 5853 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttccaaggatttggcctgtggctggggaaataacacacacgagataggtaacaaggatttacactgacatatggggtgttggtttggctctattctttttcggttaccacttcttgcagtgtaggtggagatgcctctgttccttcttcccagccctcagcaacaccagcaagctcgtagtgctttttccgaagctctcccagtttttgacgctccttctgcaattcattttctagctctagcaccctaacctgagaatccatctcttggcgtttgatctgtgtcagcgtcatgcttgagaagtccatgttgtctgtctcttcgatctgtgatttgccggaaatggttgaggccacaacgccggcagtggcctggttcactccccgagaggcctgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 186 - DNA, 5560 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtctgtagagagttcctgtaaactatccttatcttcttcatctgatccaagaaatttgtgaagtttatgaatccaagttagcccaacactatgtacaccagcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 187 - DNA, 5550 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgctgggggaagggtgcagcaacgatttctcaccaaatcactacacaggacagcaaaggggtgagaaggggctgagggaggaaaagccagggtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 188 - DNA, 5604 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttggaggaagatccactgggaaattccctgaggccaggaaggttcagcttcagtccatttggtctacagacaccttgattctccagaggaaaattctttgacttttgagaagattgaacagcaggatcatcatcaaaggtgacccgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 189 - DNA, 5573 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtcgagcttcattccgcatcaggtgcagctcccggaatttgcgcagtctctgttcgcgcttctgagcggccagctccgccgccgcagcgagggacccctcctccgcgctgtccacgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 190 - DNA, 5640 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgttggttccgttgggttaacagtgtcattttaaaatgccataaattaaataagttagttcacattttttttcccccagcacttaagttacagttagtctctaatgtgcttttgaagcttgctttagctgttccaggtctcttctgcggacagtggtggctctgggacaaccatattcgtccagtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 191 - DNA, 5967 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgcaaaaactgccacaatcttgctcaaagtgtctaagtatccaaatggtagcaaatgagctgcattaagctttatataaccacattgcatatgaagaaaaaaaatgaaatttatgccgatataaatagaaatgttacagagtatcatatactgagagtaacctatgcagttcttttaaacttatctctttagtggtttcaataaaatatcactaaccacttatccctaaagcctcaagttttcttcatttgaatgctgtagaattgcattagtattttatattgattatataaattaagaccaatttctatctaagtatgtgcttcaagcaatgttttgtggcaaacacacaaaacatgctttgctcttcaaatttattatccttaaaataatgcacttttaaagccttcacttcatagtttggtaactaagatccacatgatacacaatgccttgctgaacacagaaaatgtatctgcattatgataatgaaacccggcttttgctggtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 192 - DNA, 6092 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtggcagcctgaagaaggtaggaaagccttagtagagggaaaatcaaaccaaatgagattaggtcaaaagaacagataactatcgtctgcttatctacttaaaggtgtgtggcatttaccacagtgaggagctaacaggagcctcccacactacatgcagggcccaaaggggccagcgatggtgtgataaccagtcaccgatgatgagttgcagttggaccacgtacagatggaggggctggcccatgcagggcctcggggtgaggttcactaggactagctgcagggggacctggctacactctgtggcacaacagggcttcacaaaatggacactacacgtgacgtgggctgaaaggtggagcagagactgggtgggagtgtcagttgtacgttgtggggtaagggggagagggagcagggcaagtgtattatgtactgtgctctaacattctttggaagtctttcaaagattgctgcagttcctttttaaaacaggtctcttattccgtcattcttgaaagacttctccttacaccatctcatactgattggccgtgatgaaccgggacagacagcaggccagcagcatgccaattaactgggagaatgcgattccaaacgccactccagcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 193 - DNA, 6164 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtgcaagcctatgatggccactgtgaaaaggaccagggagaatagaaccatgaggaagacataggtggagtgggaggaaggtgtggacaatggttgctcagctgggatcatgttggtcaggttcagcatgtagcccaaagtccagccggcgtcgctgccctggatcttgccaatgaaatggatgtgctcccaggaatcagctgtgaaatgatagccttgcagaaggagggagagaatgtaggtaccagaaaagcagtattcactcaggtacttctcctttactccagcgtaagatgtttttatctcctctcaaggctgagcacagaactttttcatcatctcagtcaccttttcctgagagactttctctgatgtcaagtttaaaaacttcatcacaaagtaaaaagctgaaaatgccccaaaatccccctggagtggtggcaagaaaatcccattgaaggcacactgggagtaagggcagtaactggtgttgaagagctccaggatgctttgatggcattgttgatagtttccaataccctggatttcaaactgctggaatggaagagtcatctcaaatctcttggtgcagggggtcttgtaaaggtcacttacgttcactaccttcttatatccaggatgaaagcatgggtccctgagaatttcattacttgcaacctgaatgtccttggccagtttctgccaggtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 194 - DNA, 5717 bp, Homo sapiens
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagaattcacgcgtggccgcgggaattcgattattaaccctcactaaatgctggggatcatggatcctctgaggactgtttttaaaaagctgaagaggagaaggaagagaggactacttcttcccataggtgcagctgcaaagacatcaagctggacccatcgaggatttcggattcagccatcatggggctgctgccggggaagccactgcccctcctttctccccagcatttagtgagggttaataatcactagtgaattcgcggccgcgtcgacccgggcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatccgataaggatcgatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 195 - DNA, 29 bp, Artificial Sequence
  Description of Artificial Sequence: PCR primer GV1-1
cgggtcgacatggcagaaggtggatttga

SEQ ID NO: 196 - DNA, 29 bp, Artificial Sequence
  Description of Artificial Sequence: PCR primer GV1-2
cgcacgcgtctggttggctttccaggtag

SEQ ID NO: 197 - DNA, 29 bp, Artificial Sequence
  Description of Artificial Sequence: PCR primer GV2-1
cgggtcgacgggatagggatggggtcagg

SEQ ID NO: 198 - DNA, 29 bp, Artificial Sequence
  Description of Artificial Sequence: PCR primer GV2-2
cgcacgcgtgaccggggaatggaaggaga

SEQ ID NO: 199 - DNA, 30 bp, Artificial Sequence
  Description of Artificial Sequence: PCR primer GV3-1
cgggtcgacgctggaggaaccgatttcagg

SEQ ID NO: 200 - DNA, 29 bp, Artificial Sequence
  Description of Artificial Sequence: PCR primer GV3-2
cgcacgcgttgggtggggaaggcaatcta

SEQ ID NO: 201 - DNA, 29 bp, Artificial Sequence
  Description of Artificial Sequence: PCR primer GV4-1
cgggtcgactggctcaggtggttggagaa

SEQ ID NO: 202 - DNA, 29 bp, Artificial Sequence
  Description of Artificial Sequence: PCR primer GV4-2
cgcacgcgtggggatgtcccatcttgtgc

SEQ ID NO: 203 - DNA, 29 bp, Artificial Sequence
  Description of Artificial Sequence: PCR primer GV5-1
cgggtcgacacttgcggcagaagctggag

SEQ ID NO: 204 - DNA, 29 bp, Artificial Sequence
  Description of Artificial Sequence: PCR primer GV5-2
cgcacgcgtccgacacacgtccttggaga

SEQ ID NO: 205 - DNA, 29 bp, Artificial Sequence
  Description of Artificial Sequence: PCR primer GV6-1
cgggtcgacacggaccagatgtggcgaat

SEQ ID NO: 206 - DNA, 29 bp, Artificial Sequence
  Description of Artificial Sequence: PCR primer GV6-2
cgcacgcgtacgagaatggaggccacgac

SEQ ID NO: 207 - DNA, 29 bp, Artificial Sequence
  Description of Artificial Sequence: PCR primer GV7-1
cgggtcgacagcgtcgaaagtggccagaa

SEQ ID NO: 208 - DNA, 29 bp, Artificial Sequence
  Description of Artificial Sequence: PCR primer GV7-2
cgcacgcgttgcgtgcttgctttctcagg

SEQ ID NO: 209 - DNA, 31 bp, Artificial Sequence
  Description of Artificial Sequence: PCR primer GV8-1
cgggtcgacggagctggtcctttcagccata

SEQ ID NO: 210 - DNA, 33 bp, Artificial Sequence
  Description of Artificial Sequence: PCR primer GV8-2
cgcacgcgtccgtccattcttatcctccatctg

SEQ ID NO: 211 - DNA, 29 bp, Artificial Sequence
  Description of Artificial Sequence: PCR primer GV9-1
cgggtcgactgcctctgttcggtctggtg

SEQ ID NO: 212 - DNA, 29 bp, Artificial Sequence
  Description of Artificial Sequence: PCR primer GV9-2
cgcacgcgtggaggggagagaacccaaca

SEQ ID NO: 213 - DNA, 29 bp, Artificial Sequence
  Description of Artificial Sequence: PCR primer GV10-1
cgggtcgacttccagaggggtgacagcaa

SEQ ID NO: 214 - DNA, 29 bp, Artificial Sequence
  Description of Artificial Sequence: PCR primer GV10-2
cgcacgcgtgatggagctgtgcctgtgga

SEQ ID NO: 215 - DNA, 30 bp, Artificial Sequence
  Description of Artificial Sequence: PCR primer GV11-1
cgggtcgacgctgggttcagttccttgtgc

SEQ ID NO: 216 - DNA, 30 bp, Artificial Sequence
  Description of Artificial Sequence: PCR primer GV11-2
cgcacgcgtcgcatcatcagggagatctgg

SEQ ID NO: 217 - DNA, 31 bp, Artificial Sequence
  Description of Artificial Sequence: PCR primer GV12-1
cgggtcgacggtggaacaacttcgtgagagc

SEQ ID NO: 218 - DNA, 29 bp, Artificial Sequence
  Description of Artificial Sequence: PCR primer GV12-2
cgcacgcgtaagtttgggaaccgctggtg

SEQ ID NO: 219 - DNA, 33 bp, Artificial Sequence
  Description of Artificial Sequence: PCR primer GV13-1
cgggtcgacggttttctgacatccaatgacacc

SEQ ID NO: 220 - DNA, 29 bp, Artificial Sequence
  Description of Artificial Sequence: PCR primer GV13-2
cgcacgcgtgcgcttgttaggggctgaag

SEQ ID NO: 221 - DNA, 33 bp, Artificial Sequence
  Description of Artificial Sequence: PCR primer GV14-1
cgggtcgactctgcgcaagatctagtcatctgg

SEQ ID NO: 222 - DNA, 29 bp, Artificial Sequence
  Description of Artificial Sequence: PCR primer GV14-2
cgcacgcgtttccacatccttgtgggtca

SEQ ID NO: 223 - DNA, 27 bp, Artificial Sequence
  Description of Artificial Sequence: PCR primer GS-PGS-F
cgggtcgacggccgcgggaattcgatt

SEQ ID NO: 224 - DNA, 27 bp, Artificial Sequence
  Description of Artificial Sequence: PCR primer GS-PGM-R
cgcacgcgtgcggccgcgaattcacta

SEQ ID NO: 225 - DNA, 1874 bp, Homo sapiens
  GS-N50
  ref <308>: DATABASE ACCESSION NUMBER: GENBANK/BC008372
  ref <309>: DATABASE ENTRY DATE: 2001-07-12
  ref <313>: RELEVANT RESIDUES: (1)..(1874)
agttccgcggggggctgtcggggaaccatggctgccccgagagacaatgtcacttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgcaaaaaaaaaaaaaaaaaaaaaaaaaaaaaa

SEQ ID NO: 226 - DNA, 30 bp, Artificial Sequence
  Description of Artificial Sequence: PCR primer GV16-1
cgggtcgacaacacaggcccaaaaggtgtg

SEQ ID NO: 227 - DNA, 29 bp, Artificial Sequence
  Description of Artificial Sequence: PCR primer GV16-2
cgcacgcgtccctggaatgccatcctcat

SEQ ID NO: 228 - DNA, 29 bp, Artificial Sequence
  Description of Artificial Sequence: PCR primer GV17-1
cgggtcgacgctgtgtggtgggaaccaag

SEQ ID NO: 229 - DNA, 29 bp, Artificial Sequence
  Description of Artificial Sequence: PCR primer GV17-2
cgcacgcgttgagaccccaccaactgcaa

SEQ ID NO: 230 - DNA, 29 bp, Artificial Sequence
  Description of Artificial Sequence: PCR primer GV18-1
cgggtcgactggcggcacaatcactatca

SEQ ID NO: 231 - DNA, 29 bp, Artificial Sequence
  Description of Artificial Sequence: PCR primer GV18-2
cgcacgcgtgctggtgggttcctctggtg

SEQ ID NO: 232 - DNA, 29 bp, Artificial Sequence
  Description of Artificial Sequence: PCR primer GV19-1
cgggtcgactatatgcgtcaggcaggaga

SEQ ID NO: 233 - DNA, 29 bp, Artificial Sequence
  Description of Artificial Sequence: PCR primer GV19-2
cgcacgcgtgctcttacgggaatgtctgc

SEQ ID NO: 234 - DNA, 32 bp, Artificial Sequence
  Description of Artificial Sequence: PCR primer GV20-1
cgggtcgacggagctgggagagagatctagca

SEQ ID NO: 235 - DNA, 33 bp, Artificial Sequence
  Description of Artificial Sequence: PCR primer GV20-2
cgcacgcgtcagatcttgtagatggctgggtca

SEQ ID NO: 236 - DNA, 29 bp, Artificial Sequence
  Description of Artificial Sequence: PCR primer GV21-1
cgggtcgactggccaacgagcacaagaaa

SEQ ID NO: 237 - DNA, 29 bp, Artificial Sequence
  Description of Artificial Sequence: PCR primer GV21-2
cgcacgcgtttccactgcaggcgggttat

SEQ ID NO: 238 - DNA, 33 bp, Artificial Sequence
  Description of Artificial Sequence: PCR primer GV22-1
cgggtcgacgagttcaattccacaccagctgtc

SEQ ID NO: 239 - DNA, 29 bp, Artificial Sequence
  Description of Artificial Sequence: PCR primer GV22-2
cgcacgcgtgaaaggccgtccatcaaagc

SEQ ID NO: 240 - DNA, 29 bp, Artificial Sequence
  Description of Artificial Sequence: PCR primer GV23-1
cgggtcgacgctttgggtgagagcccaga

SEQ ID NO: 241 - DNA, 29 bp, Artificial Sequence
  Description of Artificial Sequence: PCR primer GV23-2
cgcacgcgtccgggtggtcaagacagaca

SEQ ID NO: 242 - DNA, 29 bp, Artificial Sequence
  Description of Artificial Sequence: PCR primer GV24-1
cgggtcgacggtgaggggaagtggcttcg

SEQ ID NO: 243 - DNA, 30 bp, Artificial Sequence
  Description of Artificial Sequence: PCR primer GV24-2
cgcacgcgtaaaatgacgctccacctgctg

SEQ ID NO: 244 - DNA, 31 bp, Artificial Sequence
  Description of Artificial Sequence: PCR primer GV25-1
cgggtcgacccatccaccaaggagaaacagc

SEQ ID NO: 245 - DNA, 31 bp, Artificial Sequence
  Description of Artificial Sequence: PCR primer GV25-2
cgcacgcgtcccttagacattgtcccaaacc

SEQ ID NO: 246 - DNA, 29 bp, Artificial Sequence
  Description of Artificial Sequence: PCR primer GV26-1
cgggtcgactgccttcatgaggtccacca

SEQ ID NO: 247 - DNA, 29 bp, Artificial Sequence
  Description of Artificial Sequence: PCR primer GV26-2
cgcacgcgtttccctgctgccatcaatca

SEQ ID NO: 248 - DNA, 29 bp, Artificial Sequence
  Description of Artificial Sequence: PCR primer GV27-1
cgggtcgacgcatggccctgtttcctgtt

SEQ ID NO: 249 - DNA, 29 bp, Artificial Sequence
  Description of Artificial Sequence: PCR primer GV27-2
cgcacgcgtcgagtgggcaggcctgtatc

SEQ ID NO: 250 - DNA, 29 bp, Artificial Sequence
  Description of Artificial Sequence: PCR primer GV28-1
cgggtcgacttccctaccccaccccagtc

SEQ ID NO: 251 - DNA, 29 bp, Artificial Sequence
  Description of Artificial Sequence: PCR primer GV28-2
cgcacgcgttgggaagcattggctggttc

SEQ ID NO: 252 - DNA, 29 bp, Artificial Sequence
  Description of Artificial Sequence: PCR primer GV29-1
cgggtcgacggtcccgtcaagggcactct

SEQ ID NO: 253 - DNA, 29 bp, Artificial Sequence
  Description of Artificial Sequence: PCR primer GV30-2
cgcacgcgttcccacaactttcgctgcat

SEQ ID NO: 254 - DNA, 29 bp, Artificial Sequence
  Description of Artificial Sequence: PCR primer GV30-1
cgggtcgacctgagcctgctctgggaagc

SEQ ID NO: 255 - DNA, 29 bp, Artificial Sequence
  Description of Artificial Sequence: PCR primer GV30-2
cgcacgcgttgaggctgggttctgggttc

SEQ ID NO: 256 - DNA, 29 bp, Artificial Sequence
  Description of Artificial Sequence: PCR primer GV31-1
cgggtcgacgggagctgagccagtcatgg

SEQ ID NO: 257 - DNA, 29 bp, Artificial Sequence
  Description of Artificial Sequence: PCR primer GV31-2
cgcacgcgtagctggccttggggttgaag

SEQ ID NO: 258 - DNA, 30 bp, Artificial Sequence
  Description of Artificial Sequence: PCR primer GV32-1
cgggtcgactccctgtggaccctgaagaaa

SEQ ID NO: 259 - DNA, 29 bp, Artificial Sequence
  Description of Artificial Sequence: PCR primer GV32-2
cgcacgcgtcctctttcagcctgggcact

SEQ ID NO: 260 - DNA, 31 bp, Artificial Sequence
  Description of Artificial Sequence: PCR primer GV33-1
cgggtcgacttgaagcactcaagccatccac

SEQ ID NO: 261 - DNA, 29 bp, Artificial Sequence
  Description of Artificial Sequence: PCR primer GV33-2
cgcacgcgttggaagcgctaaggcgtgac

SEQ ID NO: 262 - DNA, 30 bp, Artificial Sequence
  Description of Artificial Sequence: PCR primer GV34-1
cgggtcgactggagctggaggagatgttgg

SEQ ID NO: 263 - DNA, 29 bp, Artificial Sequence
  Description of Artificial Sequence: PCR primer GV34-2
cgcctcgagttccgggcctgactctggta

SEQ ID NO: 264 - DNA, 29 bp, Artificial Sequence
  Description of Artificial Sequence: PCR primer GV35-1
cgggtcgacgagcaggccgtggaacacat

SEQ ID NO: 265 - DNA, 29 bp, Artificial Sequence
  Description of Artificial Sequence: PCR primer GV35-2
cgcacgcgttgcttggtgtgcaggcttgt

SEQ ID NO: 266 - DNA, 33 bp, Artificial Sequence
  Description of Artificial Sequence: PCR primer GV36-1
cgggtcgaccagaggaacctacaacctctgatg

SEQ ID NO: 267 - DNA, 29 bp, Artificial Sequence
  Description of Artificial Sequence: PCR primer GV36-2
cgcacgcgttggagctgggtgagttgatg

SEQ ID NO: 268 - DNA, 29 bp, Artificial Sequence
  Description of Artificial Sequence: PCR primer GV37-1
cgggtcgacaggcctctcggggagtgaac

SEQ ID NO: 269 - DNA, 29 bp, Artificial Sequence
  Description of Artificial Sequence: PCR primer GV37-2
cgcacgcgttccaaggatttggcctgtgg

SEQ ID NO: 270 - DNA, 33 bp, Artificial Sequence
  Description of Artificial Sequence: PCR primer GV38-1
cgggtcgacgctggtgtacatagtgttgggcta

SEQ ID NO: 271 - DNA, 36 bp, Artificial Sequence
  Description of Artificial Sequence: PCR primer GV38-2
cgcacgcgtctgtagagagttcctgtaaactatcct

SEQ ID NO: 272 - DNA, 29 bp, Artificial Sequence
  Description of Artificial Sequence: PCR primer GV39-1
cgggtcgaccctggcttttcctccctcag

SEQ ID NO: 273 - DNA, 27 bp, Artificial Sequence
  Description of Artificial Sequence: PCR primer GV40-2
cgcacgcgtgctgggggaagggtgcag

SEQ ID NO: 274 - DNA, 33 bp, Artificial Sequence
  Description of Artificial Sequence: PCR primer GV40-1
cgggtcgacgggtcacctttgatgatgatcctg

SEQ ID NO: 275 - DNA, 31 bp, Artificial Sequence
  Description of Artificial Sequence: PCR primer GV40-2
cgcacgcgttggaggaagatccactgggaaa

SEQ ID NO: 276 - DNA, 27 bp, Artificial Sequence
  Description of Artificial Sequence: PCR primer GV41-1
cgggtcgacgtggacagcgcggaggag

SEQ ID NO: 277 - DNA, 29 bp, Artificial Sequence
  Description of Artificial Sequence: PCR primer GV41-2
cgcacgcgtcgagcttcattccgcatcag

SEQ ID NO: 278 - DNA, 33 bp, Artificial Sequence
  Description of Artificial Sequence: PCR primer GV42-1
cgggtcgactggacgaatatggttgtcccagag

SEQ ID NO: 279 - DNA, 31 bp, Artificial Sequence
  Description of Artificial Sequence: PCR primer GV42-2
cgcacgcgttggttccgttgggttaacagtg

SEQ ID NO: 280 - DNA, 29 bp, Artificial Sequence
  Description of Artificial Sequence: PCR primer GV43-1
cgggtcgaccagcaaaagccgggtttcat

SEQ ID NO: 281 - DNA, 31 bp, Artificial Sequence
  Description of Artificial Sequence: PCR primer GV43-2
cgcacgcgtgcaaaaactgccacaatcttgc

SEQ ID NO: 282 - DNA, 29 bp, Artificial Sequence
  Description of Artificial Sequence: PCR primer GV44-1
cgggtcgacgctggagtggcgtttggaat

SEQ ID NO: 283 - DNA, 31 bp, Artificial Sequence
  Description of Artificial Sequence: PCR primer GV44-23
cgcacgcgtggcagcctgaagaaggtaggaa

SEQ ID NO: 284 - DNA, 4197 bp, Homo sapiens
  misc_feature (1951)..(1951): a, t, c or g
  misc_feature (1952)..(1952): a, t, c or g
  misc_feature (1953)..(1953): a, t, c or g
  misc_feature (1954)..(1954): a, t, c or g
  misc_feature (1955)..(1955): a, t, c or g
  misc_feature (1956)..(1956): a, t, c or g
  misc_feature (1957)..(1957): a, t, c or g
  misc_feature (1958)..(1958): a, t, c or g
  misc_feature (1959)..(1959): a, t, c or g
  ref <308>: DATABASE ACCESSION NUMBER: Genbank/XM_038751
  ref <309>: DATABASE ENTRY DATE: 2001-10-16
gatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctnnnnnnnnngatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttct

SEQ ID NO: 285 - DNA, 1304 bp, Homo sapiens
  ref <308>: DATABASE ACCESSION NUMBER: Genbank/BC006483
  ref <309>: DATABASE ENTRY DATE: 2001-07-12
atttgatggcgtgatgtctcacagaaagttctccgctcccagacatgggtccctcggcttcctgcctcggaagcgcagcagcaggcatcgtgggaaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaaaaaaaaaaaaaag

SEQ ID NO: 286 - DNA, 1332 bp, Homo sapiens
  ref <308>: DATABASE ACCESSION NUMBER: Genbank/BC012786
  ref <309>: DATABASE ENTRY DATE: 2001-08-20
ggcacgaggatttgatggcgtgatgtctcacagaaagttctccgctcccagacatgggtccctcggcttcctgcctcggaagcgcagcagcaggcatcgtgggaaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaaaaaaaaaaaaaaaaaaaaaaaaaaaaaaaaaa

SEQ ID NO: 287 - DNA, 3936 bp, Homo sapiens
  ref <308>: DATABASE ACCESSION NUMBER: Genbank/AF265230
  ref <309>: DATABASE ENTRY DATE: 2001-06-02
ggaagttctgccttgtctccgccgcgggtcaggggtgagagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctcttatcccggaagctaaacagtggagataatctgatagtggaggaagcagtgcaggagctgaactctttcctcgcacaggagaatatgaggctacaggaattgacagatcttcttcaggaaaagcatcgcaccatgtctcaggagttctccaagttgcagagtaaagtggagacagccgaatcacgagtgtctgtcctggagtccatgattgatgacctgcagtgggatattgacaaaattcgaaagagggaacagcgactcgaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaagactttgaggaggtcactacacaaaatgaaaagctgaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgagcgagatgaggttagtcttcataagaagctgaggactgaagtaattcagctagaagatacattggcccaggtccgcaaggagtatgaaatgctgaggatagaatttgagcagacccttgctgccaatgaacaagcaggccctataaacagggagatgcgccacctcatcagtagcctccagaatcacaatcaccagctgaaaggggaggtcctgagatataagcggaaattgagagaagcccagtctgacctgaacaagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacacgaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggttgatgcccagctacaggtagtaaggaaactggaagagaaggagcatctgttacagagcaacattggcacaggggagaaggagctgggtcttaggacccaagccttagagatgaataaacgcaaggcaatggaggcagcccagcttgcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacaaagaaaccagacaatgtacccaagtgtgatgagattctgatggaagagattaaggattacaaggcacgcttgacctgtccatgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaagccttgggtttcagaatgaattagaaacaaataactcttactgtcttccctcccagctttgtttattttgtgcttttagacttttcagtgttttctttttccagcccactgtataaacttggattgtccattcctcctgaagaaatcaagttggtatttttgatgtggaaaagggaacaaaagtggaaacatggctacttttggggagtgatattttaaaaaataagttgtctatgggcacaaagttttcttcatttgtgtagcaaacttcttgtgaatgtggattacaaaatggtataattgtgctactctcccctgggtggtttgcagccctaatgaaattatgtctaggatgattcagtctatttcccatttactagcagagtaacttgttaagatcagctggctttcttgttaaagttatttaagttttgaatgctctactacttcaagtctttaaatttcttgagactagaataattttaaataatatgaccctttgtcttctaatgaaataaagattgaagaggttgagtcaggactgagctggtgaagaaatcttgtgggtattctggaaatttgatacggagagaacttggtgagctatgaattactctcagtctcctttttacagggttgttgtgatccctcttttccagaaaattctgtggaatgtttctgtaggactttgttctccacaagcttgaattaaagcaggattcagtt

SEQ ID NO: 288 - DNA, 2994 bp, Homo sapiens
  ref <308>: DATABASE ACCESSION NUMBER: Genbank/NM_006910
  ref <309>: DATABASE ENTRY DATE: 2001-03-06
ggcacgaggaaacctctaggtccaccacctccatcttacacgtgtttccgttgtggtaaacctggacattatattaagaattgcccaacaaatggggataaaaactttgaatctggtcctaggattaaaaagagcactggaattcccagaagttttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctgggtcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggag

SEQ ID NO: 289 - DNA, 2527 bp, Homo sapiens
  ref <308>: DATABASE ACCESSION NUMBER: Genbank/M30448
  ref <309>: DATABASE ENTRY DATE: 1994-11-01
tccgggcctggcctgtacggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactaccgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatgcgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatgaaaaaaaaaaaaaaaaaaaaaaaaaaggtttgtgttctcgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcctggagttgtgaacgccgcggactccggagccgcacaaaccagggctcgccatgaagccaggattcagtcccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggaggcttccattctggtggcaaccggggtcgtggtcggggaggaaaaagaggaaaccagtcggggaagaatgtgatggtggagccgcatcggactgagggtgtcttcatttgtcgaggaaaggagatgcactggtcaccaagaacctggtcctgggaatcaagttatggagagaagagagtctcgattcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagtttccccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggaatgtggccctgaaagcccacaccttcctgcgctaatggaggacactttgtgatttccattaaggccaactgcattgactccacagcctagcggtcaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcccgtgtgtttttctaattaaaagactcctccgtc

SEQ ID NO: 290 - DNA, 1818 bp, Homo sapiens
  ref <308>: DATABASE ACCESSION NUMBER: Genbank/S73813
  ref <309>: DATABASE ENTRY DATE: 1995-04-12
accacaccaagcagcggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttc

SEQ ID NO: 291 - protein, 1141 aa, Homo sapiens
  CDS protein of the sequence Genbank/XM_038751 (seq ID 284)
  misc_feature (640)..(640): Variable amino acid
  misc_feature (641)..(641): Variable amino acid
  misc_feature (642)..(642): Variable amino acid
MLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAXXXDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 292 - protein, 403 aa, Homo sapiens; identical to SEQ ID NO: 69
  CDS protein of the sequence Genbank/BC006483 (seq ID 285)

SEQ ID NO: 293 - protein, 403 aa, Homo sapiens; identical to SEQ ID NO: 69
  CDS protein of the sequence Genbank/BC012786 (seq ID 286)

SEQ ID NO: 294 - protein, 975 aa, Homo sapiens
  CDS protein of the sequence Genbank/AF265230 (seq ID 287)
MSGIGNKRAAGEPGTSMPPEKKAAVEDSGTTVETIKLGGVSSTEELDIRTLQTKNRKLAEMLDQRQAIEDELREHIEKLERRQATDDASLLIVNRYWSQFDENIRIILKRYDLEQGLGDLLTERKALVVPEPEPDSDSNQERKDDRERGEGQEPAFSFLATLASSSSEEMESQLQERVESSRRAVSQIVTVYDKLQEKVELLSRKLNSGDNLIVEEAVQELNSFLAQENMRLQELTDLLQEKHRTMSQEFSKLQSKVETAESRVSVLESMIDDLQWDIDKIRKREQRLDRHLAEVLERVNSKGYKVYGAGSSLYGGTITINARKFEEMNAELEENKELAQNRLCELEKLRQDFEEVTTQNEKLKVELRSAVEQVVKETPEYRCMQSQFSVLYNESLQLKAHLDEARTLLHGTRGTHQHQVELIERDEVSLHKKLRTEVIQLEDTLAQVRKEYEMLRIEFEQTLAANEQAGPINREMRHLISSLQNHNHQLKGEVLRYKRKLREAQSDLNKTRLRSGSALLQSQSSTEDPKDEPAELKPDSEDLSSQSSASKASQEDANEIKSKRDEEERERERREKEREREREREKEKEREREKQKLKESEKERDSAKDKEKGKHDDGRKKEAEIIKQLKIELKKAQESQKEMKLLLDMYRSAPKEQRDKVQLMAAEKKSKAELEDLRQRLKDLEDKEKKENTKMADEDALRKIRAVEEQIEYLQKKLAMAKQEEEALLSEMDVTGQAFEDMQEQNIRLMQQLREKDDANFKLMSERIKSNQIHKLLKEEKEELADQVLTLKTQVDAQLQVVRKLEEKEHLLQSNIGTGEKELGLRTQALEMNKRKAMEAAQLADDLKAQLELAQKKLHDFQDEIVENSVTKEKDMFNFKRAQEDISRLRRKLETTKKPDNVPKCDEILMEEIKDYKARLTCPCCNMRKKDAVLTKCFHVFCFECVKTRYDTRQRKCPKCNAAFGANDFHRIYIG

SEQ ID NO: 295 - protein, 948 aa, Homo sapiens
  CDS protein of the sequence Genbank/NM_006910 (seq ID 288)
MGIKTLNLVLGLKRALEFPEVFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGDVRDLLDLNLQLKKPKRRLRRLTILNHHLPLRRMKKSLEPPEKLTLNQQKTPRNKTSQRGKSEEGLFQRCQIRKANN

SEQ ID NO: 296 - protein, 215 aa, Homo sapiens
  CDS protein of the sequence Genbank/M30448 (seq ID 289)
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHAMAYQLQLQAASNFKSPVKTIR

SEQ ID NO: 297 - protein, 511 aa, Homo sapiens
  CDS protein of the sequence Genbank/S73813 (seq ID 290)
DMEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 298 - DNA, 29 bp, Artificial Sequence
  Description of Artificial Sequence: PCR primer GV45-1
cgggtcgacctggcagaaactggccaagg

SEQ ID NO: 299 - DNA, 30 bp, Artificial Sequence
  Description of Artificial Sequence: PCR primer GV45-2
cgcacgcgtgcaagcctatgatggccactg

SEQ ID NO: 300 - DNA, 27 bp, Artificial Sequence
  Description of Artificial Sequence: PCR primer GS-PGM-F
cgcacgcgtggccgcgggaattcgatt

SEQ ID NO: 301 - DNA, 27 bp, Artificial Sequence
  Description of Artificial Sequence: PCR primer GS-PGS-R
cgggtcgacgcggccgcgaattcacta

The invention claimed is:

1. A pharmaceutical composition comprising a pharmaceutically acceptable carrier and a pharmaceutically effective amount of a polypeptide selected from the group consisting of the polypeptide of the amino acid sequence shown in SEQ ID NO: 58, a polypeptide having an amino acid sequence starting at about residue 1 and ending at about residue 217 of the amino acid sequence shown in SEQ ID NO: 58 and polypeptide fragment thereof; where said polypeptide or fragment thereof activates angiogenesis.

2. The pharmaceutical composition of claim 1, where the polypeptide consists of amino acid residues 2 to 217 shown in SEQ ID NO: 58.

3. A pharmaceutical composition comprising a pharmaceutically acceptable carrier and a pharmaceutically effective amount of a polypeptide consisting of amino acid residues 1 to 217 shown in SEQ ID NO: 58; where said polypeptide activates angiogenesis.

* * * * *